United States Patent
Allen et al.

(10) Patent No.: US 7,416,849 B2
(45) Date of Patent: Aug. 26, 2008

(54) HBM VARIANTS THAT MODULATE BONE MASS AND LIPID LEVELS

(75) Inventors: Kristina Allen, Hopkinton, MA (US); Anthony Anisowicz, West Newton, MA (US); James R. Graham, Arlington, MA (US); Arturo Morales, Arlington, MA (US); Paul J. Yaworsky, Rockland, MA (US); Wei Liu, Sudbury, MA (US)

(73) Assignees: Oscient Pharmaceuticals Corporation, Waltham, MA (US); Wyeth, Madison, NJ (US)

( * ) Notice: Subject to any disclaimer, the term of this patent is extended or adjusted under 35 U.S.C. 154(b) by 395 days.

(21) Appl. No.: 10/477,173

(22) PCT Filed: May 13, 2002

(86) PCT No.: PCT/US02/14877

§ 371 (c)(1), (2), (4) Date: Nov. 4, 2004

(87) PCT Pub. No.: WO02/092000

PCT Pub. Date: Nov. 21, 2002

(65) Prior Publication Data

US 2005/0070699 A1   Mar. 31, 2005

Related U.S. Application Data

(60) Provisional application No. 60/361,293, filed on Mar. 4, 2002, provisional application No. 60/353,058, filed on Feb. 1, 2002, provisional application No. 60/291,311, filed on May 17, 2001, provisional application No. 60/290,071, filed on May 11, 2001.

(51) Int. Cl.
G01N 33/50 (2006.01)
C12N 1/19 (2006.01)
C12N 1/21 (2006.01)
C12N 15/11 (2006.01)
C12N 15/12 (2006.01)
C12N 15/63 (2006.01)
C12N 5/10 (2006.01)
C07K 14/00 (2006.01)
C07K 14/435 (2006.01)

(52) U.S. Cl. .................. 435/7.1; 435/320.1; 435/252.3; 435/254.11; 435/325; 536/23.1; 536/23.5; 530/350; 530/351

(58) Field of Classification Search ........................ None
See application file for complete search history.

(56) References Cited

U.S. PATENT DOCUMENTS 5,283,173 A   2/1994   Fields et al.
5,691,153 A   11/1997  Recker et al.
6,545,137 B1  4/2003   Todd et al.
6,555,654 B1  4/2003   Todd et al.
2005/0070699 A1  3/2005   Allen et al.
2005/0196349 A1  9/2005   Wu et al.

FOREIGN PATENT DOCUMENTS

| WO | 97/12903 | 4/1997 |
| WO | 98/46743 | 10/1998 |
| WO | WO 9846743 | 10/1998 |
| WO | 99/09054 | 2/1999 |
| WO | 99/47529 | 9/1999 |
| WO | WO 00/58496 A | 10/2000 |
| WO | WO 01/92891 A | 12/2001 |
| WO | 02/16553 A2 | 2/2002 |
| WO | WO 02/092000 A2 | 11/2002 |

OTHER PUBLICATIONS

Wells, 1990, Biochemistry 29:8509-8517.*
Ngo et al., 1994, The Protein Folding Problem and Tertiary Structure Prediction, Merz et al., eds., Birkhauser, Boston, pp. 492-495.*
Bork, 2000, Genome Research 10:398-400.*
Skolnick et al., 2000, Trends in Biotech. 18(1):34-39.*
Doerks et al., 1998, Trends in Genetics 14:248-250.*
Smith et al., 1997, Nature Biotechnology 15:1222-1223.*
Brenner, 1999, Trends in Genetics 15:132-133.*
Bork et al., 1996, Trends in Genetics 12:425-427.*
U.S. Appl. No. 10/477,238, filed Nov. 10, 2003, Babij et al.
U.S. Appl. No. 10/182,936, filed Aug. 2, 2002, Allen et al.
U.S. Appl. No. 10/240,851, filed Oct. 4, 2002, Carulli et al.

(Continued)

Primary Examiner—Elizabeth C. Kemmerer
(74) Attorney, Agent, or Firm—Drinker Biddle & Reath LLP

(57) ABSTRACT

The present invention relates to methods and materials used to express an HBM-like polypeptide derived from HBM, LRP5 or LRP6 in animal cells and transgenic animals. The present invention also relates to transgenic animals expressing the HBM-like polypeptides. The invention provides nucleic acids, including coding sequences, oligonucleotide primers and probes, proteins, cloning vectors, expression vectors, transformed hosts, methods of developing pharmaceutical compositions, methods of identifying molecules involved in bone development, and methods of diagnosing and treating diseases involved in bone development and lipid modulation. In preferred embodiments, the present invention is directed to methods for treating, diagnosing and preventing osteoporosis.

26 Claims, 89 Drawing Sheets

OTHER PUBLICATIONS

Masaki Kato et al., "Cbfa 1-independent decrease in osteoblast proliferation, osteopenia, and persistent embryonic eye vascularization in mice deficient in Lrp5, a Wnt coreceptor", The Journal Cell Biology, vol. 157, No. 2, Apr. 15, 2002, pp. 303-314, The Rockefeller University Press, USA.

Anna Bafico et al., "Novel mechanism of Wnt signalling inhibition mediated by Dikkopf-1 interaction with LRP6/Arrow", Nature Cell Biology, vol. 3, Jul. 2001, pp. 683-686, Nature Publishing Group, Hampshire, United Kingdom.

Paolo Fedi, "Isolation and Biochemical Characterization of the Human Dk-1 Homologue, a Novel Inhibitor of Mammalian Wnt Signalling", The Journal of Biological Chemistry, vol. 274, No. 27, pp. 19465-19472, American Society for Biocheistry and Molecular Biology, Bethesda, Maryland, USA.

Yaogin Gong et al., "LDL Receptor-Related Protein 5 (LRP5) Affects Bone Accrual and Eye Development", Cell, vol. 107, Nov. 16, 2001, pp. 513-523, Cell Press, Cambridge, Massachusetts, USA.

Lars Grotewold et al., "Expression pattern of Dkk-1 during mouse limb development", Mechanisms of Development 89, Aug. 2, 1999, pp. 151-153, Elsevier Science, Oxford, United Kingdom.

Lars Grotewold et al., The Wnt antgonist Dickkopf-1 is regulated by Bmp signaling and c-Jun and modulates programmed cell death, The EMBO Journal, vol. 21, No. 5, pp. 966-975, 2002, Oxford University Press, USA.

Valery E. Krupnik et al., "Functional and structural diversity of the human Dickkopf gene family", Gene 238 (1999), pp. 301-313, Elsevier Science, Oxford United Kingdom.

Nan Sook Lee, "Expression of small interfering RNAs targeted against HIV-1 rev transcripts in human cells", Nature Biotechnology, vol. 19, pp. 500-505, May 2002, Nature Publishing Group, Hampshire, United Kingdom.

Lin Li et al., "Second Cysteine-rich Domain of Dickkopf-2 Activates Canonical Wnt Signaling Pathway via LRP-6 Independently of Dishevelled", The Journal of Biological Chemistry, vol. 277, No. 8, pp. 5977-5981, Feb. 2002, American Society for Biochemistry and Molecular Biology, USA.

Bingyu Mao et al., "LDL-receptor-related protein 6 is a receptor for Dickkopf proteins", Nature, vol. 411, pp. 321-325, May 2001, Nature Publishing Group, Hampshire, United Kingdom.

Makoto Miyagishi et al., "U6 promoter-driven SiRNAs with four uridine 3' overhangs efficiently suppress targeted gene expression in mammalian cells", Nature Biotechnology, vol. 19, pp. 497-500, May 2002, Nature Publishing Group, Hampshire, United Kingdom.

Roel Nusse, "Making head or tail of Dickkopf", Nature, vol. 411, pp. 255-325, May 17, 2001, Nature Publishing Group, Hampshire, United Kingdom.

Patrick J. Paddison et al., Short hairpin RNAs (shRNAs) induce sequence-specific silencing in mammalian cells, Genes & Development, vol. 16, pp. 948-958, Mar. 2002, Cold Spring Harbor Laboratory Press, New York, USA.

Cynthia P. Paul et al., "Effective expression of small interfering RNA in human cells", Nature Biotechnology, vol. 29, pp. 505-508, Nature Publishing Group, Hampshire, United Kingdom.

Minori Shinya et al., "Zebrafish Dkk1, induced by the pre-MBT Wnt signalling, is secreted from the prechordal plate and patterns the anterior neural plate", Mechanisms of Development, vol. 98, pp. 3-17, Jun. 2000, Elsevier Science, Oxford, United Kingdom.

Jiang Shou et al., "Human Dkk-1, a gene encoding a Wnt antagonist, responds to DNA damage and its overexpression sensitizes brain tumor cells to apoptosis following alkylation damage of DNA", Oncogene, vol. 21, pp. 878-889, 2002, Nature Publishing Group, Hampshire, United Kingdom.

Thomas Tuschl, "Expanding small RNA interference", Nature Biotechnology, vol. 20, pp. 446-448, May 2002, Nature Publishing Group, Hampshire, United Kingdom.

Jian Wang et al., "Dickkopf-1, an inhibitor of the Wnt signaling pathways, is induced by p53", Oncogene, vol. 19, pp. 1843-1848, Jan. 2000, Nature Publishing Group, Hampshire, United Kingdom.

Wei Wu et al., "Mutual antagonism between dickkopf1 and dickkopf2 regulates Wnt/β-catenin signalling", Current Biology, vol. 10, pp. 1611-1614, 2000, Elsevier Science, USA.

Jenn-Yah Yu, "RNA interference by expression of short-interfering RNAs and hairpin RNAs in mammalian cells", PNAS, vol. 99, No. 9, pp. 6047-6052, Apr. 30, 2002, National Academy of Science, Washington, D.C. USA.

Aaron M. Zorn, "Wnt signalling: Antagonistic Dickkopfs", Current Biology, vol. 11, pp. R592-R595, 2001, Elsevier Science, USA.

Lynn M. Boyden et al., "High Bone Density Due To A Mutation In LDL-Receptor-Related Protein 5", The New England Journal of Medicine, vol. 346, No. 20, pp. 1513-1521, May 16, 2002, Massachusetts Medical Society, Boston, Massachusetts, USA.

Sheryl D. Brown et al., "Isolation and Characterization of LRP6, a Novel Member of the Low Density Lipoprotein Receptor Gene Family," Biochemical and Biophysical Research Communications, vol. 248, Article No. RC989061 pp. 879-888, 1998, Academic Press, USA.

David Chen et al., Molecular Cloning of Mouse Lrp7(Lr3) cDNA and Chromosomal Mapping of Orthologous Genes in Mouse and Human, Genomics, vol. 55, pp. 314-321, 1999, Academic Press, USA.

Yu Dong et al., "Molecular Cloning and Characterization of LR3, a Novel LDL Receptor Family Protein with Mitogenic Activity", Biochemical and Biophysical Research Communication, vol. 251, Article No. RC989545, pp. 784-790, 1998, Academic Press, USA.

Patricia J. Hey et al., "Cloning of a novel member of the low-density lipoprotein receptor family", Gene, vol. 216, pp. 103-111, 1998, Elsevier Science, Oxford, United Kingdom.

Dong-Ho Kim et al., "A New Low Density Lipoprotein Receptor Related Protein, LRP5, is Expressed in Hepatocytes and Adrenal Cortex, and Recognizes Apolipoprotein E1", J. Biochem, vol. 124, pp. 1072-1076, 1998, American Society for Biochemistry and Molecular Biology, Maryland, USA.

D.L. Koller et al., "Linkage of a QTL Contributing to Normal Variation in Bone Mineral Density to Chromosome 11q12-13", Journal Of Bone And Mineral Research, vol. 13, No. 12, pp. 1903-1908, 1998, American Society for Bone Mineral Research, USA.

Bingyu Mao et al., "Kremen proteins are Dickkopf receptors that regulate Wnt/β-catenin signalling", Nature, 756, pp. 1-4, 2002, Nature Publishing Group, Hampshire, United Kingdom.

Junhao Mao et al., "Low-Density Lipoprotein Receptor-Related Protein-5 Binds to Axin and Regulates the Canonical Wnt Signaling Pathway", Molecular Cell, vol. 7, pp. 801-809, Apr. 2001, Cell Press, Cambridge, Massachusetts, USA.

Yusuke Nakagawa et al., "Fine Mapping of the Diabetes-Susceptibility Locus, IDDM4, on Chromosome 11q13", Am. J. Human Genet., vol. 63, pp. 547-556, 1998, The University of Chicago Press, Chicago, Illinois, USA.

Editorial, "Regulation of Bone Formation and Vision by LRP5", New England Journal of Medicine, vol. 346, No. 20, May 16, 2002, Massachusetts Medical Society, Boston, Massachusetts, USA.

Kathleen I. Pinson et al., "An LDL-receptor-related protein mediates Wnt signalling in mice", Nature, vol. 407, pp. 535-538, Sep. 2000, Nature Publishing Group, Hampshire, United Kingdom.

Keiko Tamai et al., "LDL-receptor-related proteins in Wnt signal transduction", Nature, vol. 407, pp. 530-535, Sep. 2000, Nature Publishing Group, Hampshire, United Kingdom.

Marcel Wehrli et al., "arrow encodes and LDL-receptor-related protein essential for Wingless signaling", Nature, vol. 407, pp. 527-530, Sep. 2000, Nature Publishing Group, Hampshire, United Kingdom.

Christof Niehrs et al., "Dickkopf1 and the Spemann-Mangold head organizer", Int. J. Devel. Biol. 45: pp. 237-240, 2001, UBC Press, Spain.

Isao Nozaki et al., "Reduced expression of REIC/Dkk-3 gene in non-small cell lung cancer", International Journal of Oncology 19: pp. 117-121, 2001, Lychnia Athens, Greece.

Andrei Glinka et al., "Dickkopf-1 is a member of a new family of secreted proteins and functions in head induction", Nature, vol. 391, pp. 357-362, Jan. 1998, Nature Publishing Group, Hampshire, United Kingdom.

L. Aravind et al., "A colipase fold in the carboxy-terminal domain of the Wnt antagonists—the Dikkopfs", Current Biol. Jul. 1998, 8(14): R477-8., Elsevier Science, USA.

Tim H. Szeto et al., "Isolation of a funnel-web spider polypeptide with homology tomamba intestinal toxin 1 and the embryonic head inducer Dickkopf-1", Toxicon, Mar. 2000, 38 (3), 429-442, Pergamon Press, USA.

H. Van Tilbeurgh et al., "Colipase: structure and interaction with pancreatic lipase", Biochem Biophys Acta, Nov. 1999, 1441 (2-3): 173-184, Elsevier Science, Oxford, United Kingdom.

Mahua Mukhopadhyay et al., "Dickkopf1 is Required for Embyronic Head Induction and Limb Morphogenesis in the Mouse", Developmental Cell, vol. 1, pp. 423-434, Sep. 2001, Cell Press, Cambridge, Massachusetts, USA.

Mikhail V. Semenov et al., "Head Inducer Dickkopf-1 is a ligand for Wnt coreceptor LRP6", Current Biol., Jun. 2001, 11(12) pp. 951-961, Elsevier Science, USA.

Martha J. Marvin et al., "Inhibition of Wnt activity induces heart formation from posterior mesoderm", Genes & Development, Feb. 2001, 15 (3), pp. 316-327, Cold Spring Harbor Laboratory Press, New York, USA.

Thomas Andl et al., "WNT Signals Are Required for the Initiation of Hair Follicle Development", Developmental Cell, vol. 2, pp. 643-653, May 2002, Cell Press, Cambridge, Massachusetts, USA.

Toshiya Tsuji et al., "Antiproliferative Activity of REICDkk-3 and Its Significant Down-Regulation in Non-Small-Cell Lung Carcinomas", Biochemical and Biophysical Research Communications, 289, pp. 257-263, 2001, Academic Press, NY, USA.

L.C. Kao et al., "Global Gene Profiling in Human Endometrium during the Window of Implantation", Endocrinology 143(6): pp. 2119-2138, The Endocrine Society, USA.

A. Paula Monoghan et al., "Dickkopf genes are co-ordinately expressed in mesodermal lineages", Mechanism of Development 87, pp. 45-56, 1999, Elsevier Science, Ireland.

Hisashi Hashimoto et al., "Zebrafish Dkk1 Functions in Forebrain Specification and Axial Mesendoderm Formation", Developmental Biology 217, pp. 138-152, 2000, Academic Press, New York, USA.

Annex Form PCT/ISA/206 Communication Relating to the Results of the Partial International Search attached to Invitation to Pay Additional Fees dated May 7, 2001 in PCT/US00/16951 filed on Jun. 21, 2000.

A. Courseaux et al., "*Homo sapiens* Chromosome 11 Clone BAC67-M-5 MAP 11q13, Sequencing in Progress, 3 Ordered Pieces", Database EM_HTG, E.B.I., Hinxton, U.K., Accession No. AC024123, Mar. 2, 2000, XP002165276, Abstract.

Michael P. Whyte, "Searching for Gene Defects that Cause High Bone Mass", Am. J. Hum. Genet., vol. 60; No. 6, pp. 1309-1311, Jun. 1997, The University of Chicago Press, Chicago, Illinois, USA.

Marion Trommsdorff et al., "Interaction of Cytosolic Adaptor Proteins with Neuronal Apolipoprotein E Receptors and the Amyloid Precursor Protein", J. Biol. Chem., vol. 273, No. 50, pp. 33556-33560, Dec. 1998, The American Society for Biochemistry and Molecular Biology, Inc., Bethesda, Maryland, USA.

G. Schneider et al., "Formation of Focal Adhesions by Osteoblasts Adhering to Different Substrata", Experimental Cell Research, vol. 214, No. 1, pp. 264-269, Sep. 1994, Academic Press, Inc., New York, USA.

Frederick M. Pavalko et al., "Fluid Shear-Induced Mechanical Signaling in MC3T3-E1 Osteoblasts Require Cytoskeleton-Integrin Interactions", Am. J. Physiol., vol. 275, No. 6 (Pt1), pp. C1591-C1601, Dec. 1998, The American Physiological Society, USA.

Mark L. Johnson et al., "Linkage of a Gene Causing High Bone Mass to Human Chromosome 11 (11q12-13)", Am. J. Hum. Genet., vol. 60, No. 6, pp. 1326-1332, Jun. 1997, The University of Chicago Press, Chicago, Illinois, USA.

Rodan et al., "Therapeutic approaches to bone diseases", 2000, Science, vol. 289, pp. 1508-1514, American Association for the Advancement of Science with the assistance of Stanford University's Highwire Press, USA.

Kundu et al., "Role of polypeptides in the treatment and diagnosis of osteoporosis", 1999, Peptides, vol. 20, pp. 523-537, Elsevier Science, Oxford, United Kingdom.

Ziegler et al., "Glucocorticoid-induced osteoporosis: Prevention and treatment", 1998, Steroids, vol. 63, pp. 344-348, Elsevier Science, USA.

Bollag et al., "Osteoblast-derived cells express functional glucose-dependent insulinotropic peptide receptors", 2000, Endocrinology, vol. 141, pp. 1228-1235, The Endocrine Society, USA.

Aaron Zorn. Wnt signaling: Antagonistic Dickkopfs. *Current Biology 2001*, vol. 11, No. 15, pp. R592-R595. Elsevier Science Ltd., Oxford, UK.

International Search Report mailed Aug. 8, 2003.

Johnson et al., Journal of Bone and Mineral Research, Eighteenth Annual Meeting of the American Society for Bone and Mineral Research, Aug. 1996, vol. 11 (Supplement 1):S255, Abstract S661.

Hey et al., Cloning of a Novel Member of the Low-Density Lipoprotein Receptor Family, Gene, Apr. 6, 1998, 216, pp. 103-111, Elsevier Science B.V.

Annex Form PCT/ISA/206 Communication Relating to the Results of the Partial International Search attached to Invitation to Pay Additional Fees dated May 7, 2001 in PCT/US00/16951 filed on Jun. 21, 2000.

Ye et al., Influence of Genetic Polymorphisms on Responsiveness to Dietary Fat and Cholesterol, Am. J. Clin. Nutr. 2000; vol. 72 (Suppl), pp. 1275S-1284S.

Willnow et al., Lipoprotein Receptors: New roles for Ancient Proteins. Nature Cell Biol., Oct. 1999, vol. 1, pp. E157-E162.

Little et al., A Mutation in LDL Receptor-Related Protein 5 Gene Results in the Autosomal Dominant High-Bone-Mass Trait, The American Journal of Human Genetics, 2002, vol. 70, No. 1, pp. 11-19, University of Chicago Press, Chicago.

Zielenski, Genotype and Phenotype in Cystic Fibrosis, Respiration, S. Karger AG, Basel 2000, vol. 67, pp. 117-133.

Web Page, Abstract for Research News, Researchers Discover "Thermostat" that Regulates Bone Density, Howard Hughes Medical Institute, Nov. 16, 2001, Chevy Chase, Maryland, at http://www.hhml.org/news/warman.html.

Maurer et al., Molecular Membrane Biology, Lipid Based systems for the Intracellular Delivery of Genetic Drugs, 1999, vol. 16, pp. 129-140, Taylor & Francis Ltd.

Verma et al., Gene Therapy-Promises, Problems and Prospects, Nature, Sep. 18, 1997, vol. 389, pp. 239-242.

Anderson, Human Gene Therapy, Nature, Apr. 30, 1998, vol. 392, pp. 25-30.

Walther et al., Viral Vectors for Gene Transfer, Drugs, Aug. 2000, vol. 60, pp. 249-271.

Bollag et al., Osteoblast-Derived Cells Express Functional Glucose-Dependent Insulinotropic Peptide Receptors, Endocrinology, 2000, vol. 141, pp. 1228-1235.

International Search Report mailed Jul. 11, 2001.
International Search Report mailed May 23, 2002.
International Search Report mailed May 8, 2003.
U.S. Appl. No. 09/544,398, filed Apr. 5, 2000, Carulli et al.
U.S. Appl. No. 09/543,771, filed Apr. 5, 2000, Carulli et al.
U.S. Appl. No. 09/578,900, filed May 26, 2000, Carulli et al.
U.S. Appl. No. 10/680,287, filed Oct. 8, 2003, Askew et al.
U.S. Appl. No. 10/477,238, filed Apr. 12, 2004, Babij et al.
U.S. Appl. No. 10/374,979, filed Feb. 28, 2003, Carulli et al.
U.S. Appl. No. 10/731,739, filed Dec. 10, 2003, Carulli et al.
U.S. Appl. No. 10/834,377, filed Apr. 29, 2004, Carulli et al.
European Search Report dated May 4, 2004.

Gong et al., "*LDL Receptor-Related Protein 5 (LRP5) Affects Bone Accrual and Eye Development*," Cell 107, pp. 513-523, Cell Press, Cambridge, Massachusetts, 2001.

Magoori et al., "*Severe Hypercholesterolemia, Impaired Fat Tolerance, and Advanced Atheroscleroisis in Mice Lacking Both Low Density Lipoprotein Receptor-related Protein 5 and Apolipoprotein E*," The Journal of Biological Chemistry 278(13) pp. 11331-11336, The American Society for Biochemistry and Molecular Biology, Inc., Baltimore, Maryland, 2003.

Boyden et al., "*High Bone Density Due to a Mutation in LDL-Receptor-Related Protein 5*," The New England Journal of Medicine 346(20), pp. 1513-1521, Massachusetts Medical, Boston, Massachusetts, 2002.

Van Wesenbeeck et al., "*Six Novel Missense Mutations in the LDL Receptor-Related Protein 5 (LRP5) Gene in Different Conditions with an Increased Bone Density*," Am. J. Human. Genet., 72, pp. 763-771, The University of Chicago Press, Chicago, Illinois, 2003.

Little et al., "*A Mutation in the LDL Receptor-Related Protein 5 Gene Results in the Autosomal Dominant High-Bone-Mass Trait*," Am. J. Hum. Genet., 70, pp. 11-19, The University of Chicago Press, Chicago, Illinois, 2002.

Babij et al., "*High Bone Mass in Mice Expressing a Mutant LRP5 Gene*," Journal of Bone and Mineral Research, 18, pp. 960-974, Mary Ann Liebert, New York, 2003.

Mizuguchi et al. "*LRP5, low-density-lipoprotein-receptor-related protein 5, is a determinant for bone mineral density*," J. Hum. Genet. 49, pp. 80-86, Springer Verlag, Tokyo, Japan, 2004.

International Search Report dated Aug. 10, 2004.

Johnson et al., "*The Gene for High Bone Mass*," Endocrinologist, vol. 12, No. 5, 2002, pp. 445-453; Lippincott Williams & Wilkins, Philadelphia PA.

Search Report issued in European Patent Application EP 02746370.

Lucentini, Gene Association Studies Typically Wrong, The Scientist, Dec. 20, 2004, vol. 18, p. 20.

Suwazono et al., "G-protein $\beta$3 subunit polymorphism C1429T and low-density lipoprotein receptor-related protein 5 polymorphism A1330V are risk factors for hypercholesterolemia in Japanese males—a prospective stuffy over 5 years," Metabolism Clinical and Experimental 55 (2006) pp. 751-757, Elsevier, Amsterdam, Holland.

Guo et al., "Polymorphisms of the low-density lipoprotein receptor-related protein 5 (LRP5) gene are associated with obesity phenotypes in a large family-based association study," J. Med. Genet., Published online May 24, 2006; British Medical Association; London, England, PMID: 16713434.

Krieger, "The '*best*' of cholesterols, the 'worst' of cholesterols: A tale of two receptors," Pros. Natl. Acad. Sci., 95, pp. 4077-4080, National Academy of Sciences, Washington, D.C. (1998).

Pinals et al. "Type-IV Hyperlipoproteinaemia and Transient Osteoporosis," The Lancet, 2, p. 929, Lancet Publishing Group, London, England (1972).

European Search Report dated May 4, 2004, issued in EP 00941578.

\* cited by examiner

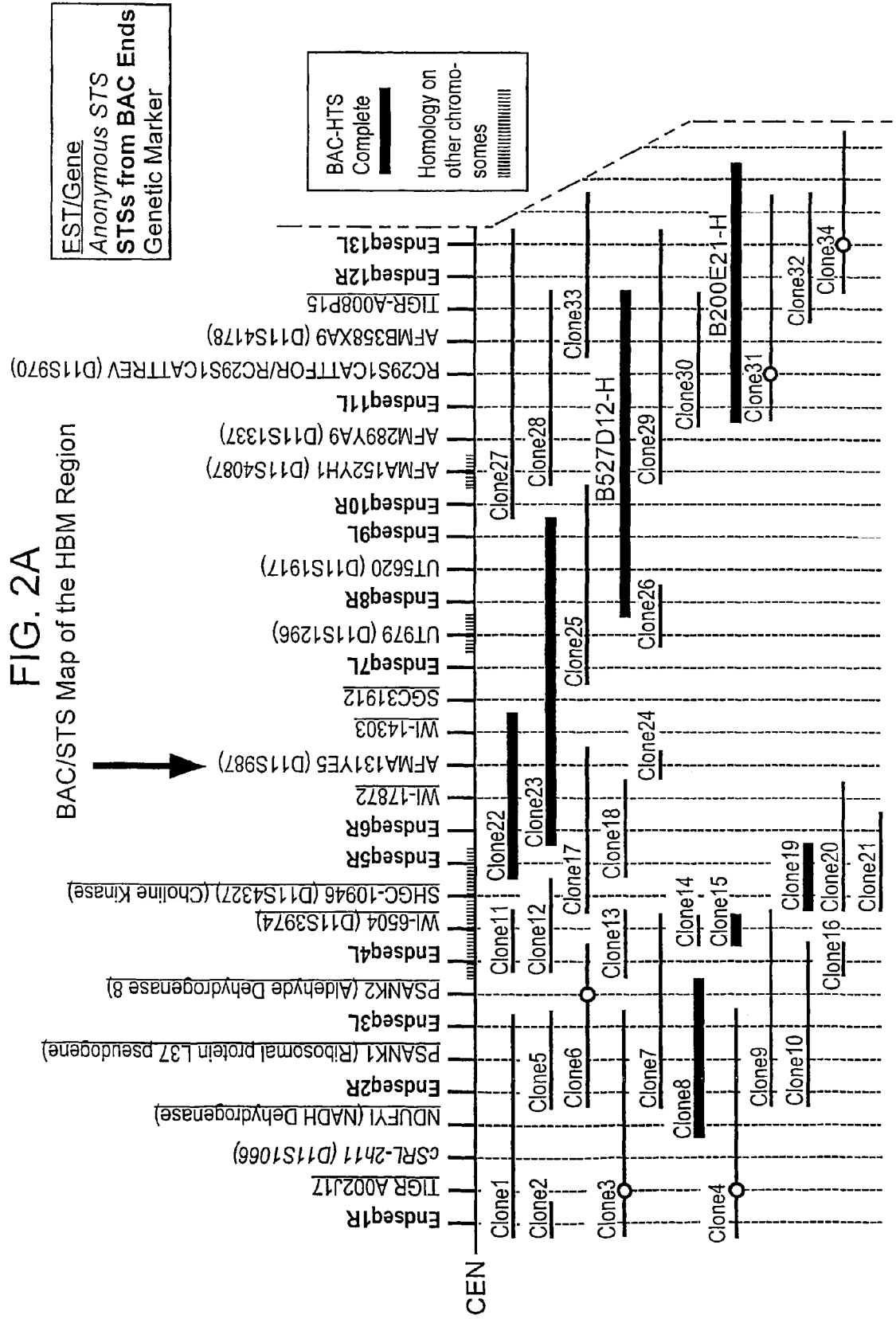

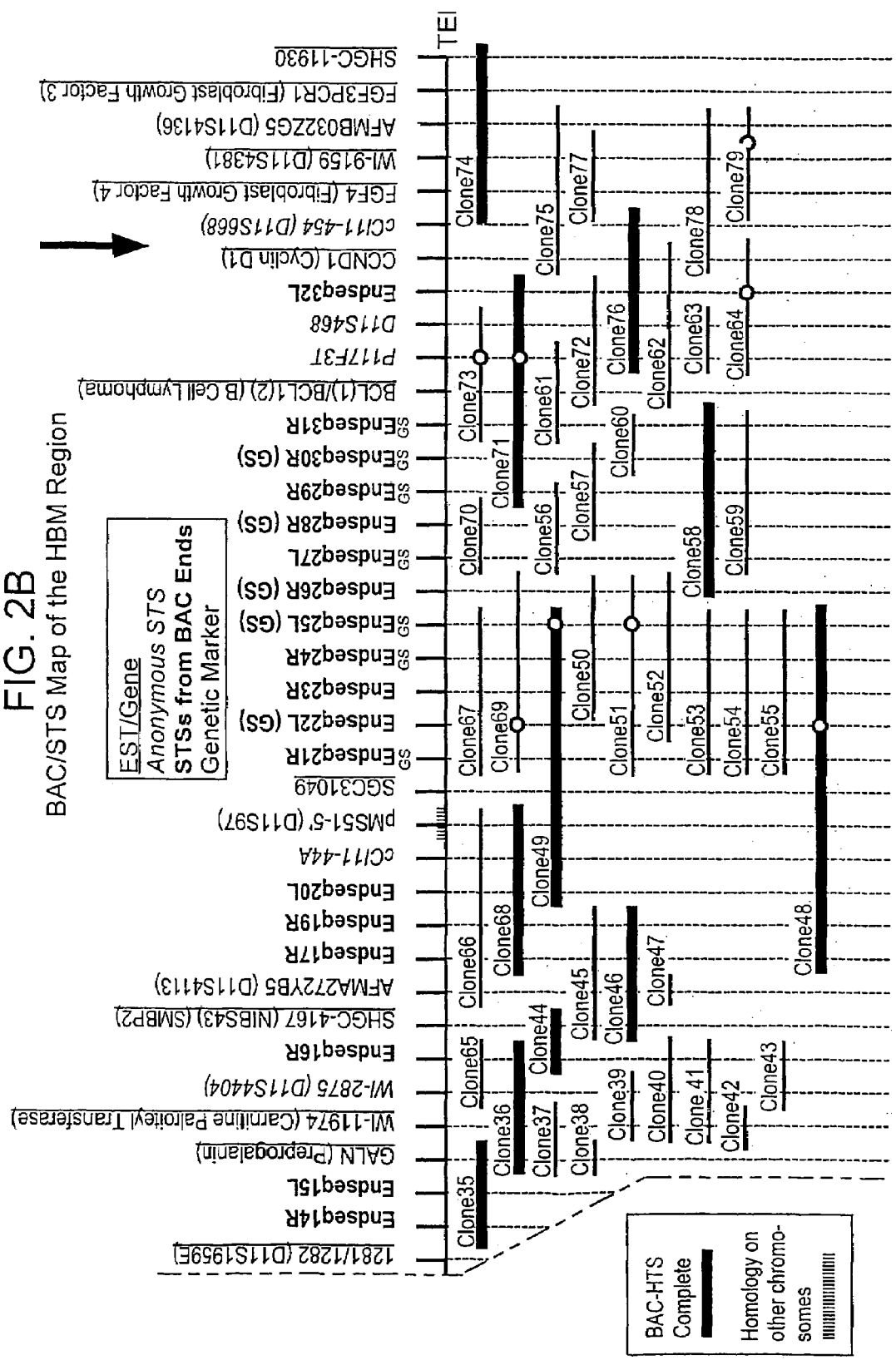

Exon 1
ACTAAAGCGCCGCCGCCGCGCCATGGAGCCCGAGTGAGCGCGGCGCG
GGCCCGTCCGGCCGCCGGACAACATGGAGGCAGCGCCGCCCGGGCCG
CCGTGGCCGCTGCTGCTGCTGCTGCTGCTGCTGGCGCTGTGCGGC
TGCCCGGCCCCCGCCGCGGCC

Exon 2 Coordinates: 527d12_Contig308G 30944-30549
gccccacagCCTCGCCGCTCCTGCTATTTGCCAACCGCCGGGACGTACGGC
TGGTGGACGCCGGCGGAGTCAAGCTGGAGTCCACCATCGTGGTCAGC
GGCCTGGAGGATGCGGCCGCAGTGGACTTCCAGTTTTCCAAGGGAGC
CGTGTACTGGACAGACGTGAGCGAGGAGGCCATCAAGCAGACCTACCT
GAACCAGACGGGGGCCGCCGTGCAGAACGTGGTCATCTCCGGCCTGG
TCTCTCCCGACGGCCTCGCCTGCGACTGGGTGGGCAAGAAGCTGTACT
GGACGGACTCAGAGACCAACCGCATCGAGGTGGCCAACCTCAATGGC
ACATCCCGGAAGGTGCTCTTCTGGCAGGACCTTGACCAGCCGAGGGCC
ATCGCCTTGGACCCCGCTCACGGgtaaaccctgctg ... 9408 nt ...

Exon 3 Coordinates: 527d12_Contig308G 21141-20945
ccccgtcacagGTACATGTACTGGACAGACTGGGGTGAGACGCCCCGGATTG
AGCGGGCAGGGATGGATGGCAGCACCCGGAAGATCATTGTGGACTCG
GACATTTACTGGCCCAATGGACTGACCATCGACCTGGAGGAGCAGAAG
CTCTACTGGGCTGACGCCAAGCTCAGCTTCATCCACCGTGCCAACCTG
GACGGCTCGTTCCGgtaggtacccac ... 6094 nt ...

Exon 4 Coordinates: 527d12_Contig308G 15047-14850
tccctgactgcagGCAGAAGGTGGTGGAGGGCAGCCTGACGCACCCCTTCGCC
CTGACGCTCTCCGGGGACACTCTGTACTGGACAGACTGGCAGACCCGC
TCCATCCATGCCTGCAACAAGCGCACTGGGGGGAAGAGGAAGGAGAT
CCTGAGTGCCCTATACTCACCCATGGACATCCAGGTGCTGAGCCAGGA
GCGGCAGCCTTTCTgtgagtgccgg ... 1827 nt ...

Exon 5 Coordinates: 527d12_Contig308G 13220-13088
tttctcagTCCACACTCGCTGTGAGGAGGACAATGGCGGCTGCTCCCACCTG
TGCCTGCTGTCCCCAAGCGAGCCTTTCTACACATGCGCCTGCCCCACG
GGTGTGCAGCTGCAGGACAACGGCAGGACGTGTAAGGCAGgtgaggcggtgg
gacg

Exon 6 Coordinates: 527d12_Contig309G 7705-8100
ctccacagGAGCCGAGGAGGTGCTGCTGCTGGCCCGGCGGACGGACCTAC
GGAGGATCTCGCTGGACACGCCGGACTTCACCGACATCGTGCTGCAGG
TGGACGACATCCGGCACGCCATTGCCATCGACTACGACCCGCTAGAGG
GCTATGTCTACTGGACAGATGACGAGGTGCGGGCCATCCGCAGGGCG
TACCTGGACGGGTCTGGGGCGCAGACGCTGGTCAACACCGAGATCAA
CGACCCCGATGGCATCGCGGTCGACTGGGTGGCCCGAAACCTCTACTG
GACCGACACGGGCACGGACCGCATCGAGGTGACGCGCCTAACGGCA
CCTCCCGCAAGATCCTGGTGTCGGAGGACCTGGACGAGCCCCGAGCC
ATCGCACTGCACCCCGTGATGGGgtaagacgggc ..... 3211 nt .....

Exon 7 Coordinates: 527d12_Contig309G 11311-11482
ttcttctccagCCTCATGTACTGGACAGACTGGGGAGAGAACCCTAAAATCGA
GTGTGCCAACTTGGATGGGCAGGAGCGGCGTGTGCTGGTCAATGCCTC
CCTCGGGTGGCCCAACGGCCTGGCCCTGGACCTGCAGGAGGGGAAGC
TCTACTGGGGAGACGCCAAGACAGACAAGATCGAGgtgaggctcctgtgg ...... 13445 nt .....

Exon 8 Coordinates: 527d12_Contig309G 24927-25143
ccgtcctgcagGTGATCAATGTTGATGGGACGAAGAGGCGGACCCTCCTGGA
GGACAAGCTCCCGCACATTTTCGGGTTCACGCTGCTGGGGGACTTCAT
CTACTGGACTGACTGGCAGCGCCGCAGCATCGAGCGGGTGCACAAGG
TCAAGGCCAGCCGGGACGTCATCATTGACCAGCTGCCCGACCTGATGG
GGCTCAAAGCTGTGAATGTGGCCAAGGTCGTCGgtgagtccgggggtc ....2826 nt ......

Exon 9 Coordinates: 527d12_Contig309G 27969-28256
gttcgcttccagGAACCAACCCGTGTGCGGACAGGAACGGGGGGTGCAGCCA
CCTGTGCTTCTTCACACCCCACGCAACCCGGTGTGGCTGCCCCATCGG
CCTGGAGCTGCTGAGTGACATGAAGACCTGCATCGTGCCTGAGGCCTT
CTTGGTCTTCACCAGCAGAGCCGCCATCCACAGGATCTCCCTCGAGAC
CAATAACAACGACGTGGCCATCCCGCTCACGGGCGTCAAGGAGGCCTC
AGCCCTGGACTTTGATGTGTCCAACAACCACATCTACTGGACAGACGT
CAGCCTGAAGgtagcgtgggc

Exon 10 Coordinates: 527d12_Contig309G 31358-31582
cctgctgccagACCATCAGCCGCGCCTTCATGAACGGGAGCTCGGTGGAGCA
CGTGGTGGAGTTTGGCCTTGACTACCCCGAGGGCATGGCCGTTGACTG
GATGGGCAAGAACCTCTACTGGGCCGACACTGGGACCAACAGAATCGA
AGTGGCGCGGCTGGACGGGCAGTTCCGGCAAGTCCTCGTGTGGAGGG
ACTTGGACAACCCGAGGTCGCTGGCCCTGGATCCCACCAAGGGgtaagtgtt
tgcctgtc ......1297 nt......

Exon 11 Coordinates: 527d12_Contig309G 32879-33064
gtgccttccagCTACATCTACTGGACCGAGTGGGGCGGCAAGCCGAGGATCG
TGCGGGCCTTCATGGACGGGACCAACTGCATGACGCTGGTGGACAAG
GTGGGCCGGGCCAACGACCTCACCATTGACTACGCTGACCAGCGCCTC
TACTGGACCGACCTGGACACCAACATGATCGAGTCGTCCAACATGCTG
Ggtgagggccgggct .......2069 nt.....

Exon 12 Coordinates: 527d12_Contig309G 35133-35454
gtgttcatgcagGTCAGGAGCGGGTCGTGATTGCCGACGATCTCCCGCACCCG
TTCGGTCTGACGCAGTACAGCGATTATATCTACTGGACAGACTGGAAT
CTGCACAGCATTGAGCGGGCCGACAAGACTAGCGGCCGGAACCGCAC
CCTCATCCAGGGCCACCTGGACTTCGTGATGGACATCCTGGTGTTCCA
CTCCTCCCGCCAGGATGGCCTCAATGACTGTATGCACAACAACGGGCA
GTGTGGGCAGCTGTGCCTTGCCATCCCCGGCGGCCACCGCTGCGGCT
GCGCCTCACACTACACCCTGGACCCCAGCAGCCGCAACTGCAGCCgtaag
tgcctcatggt .......2006 nt......

Exon 13 Coordinates: 527d12_Contig309G 37460-37659
gcctcctctaCGCCCACCACCTTCTTGCTGTTCAGCCAGAAATCTGCCATCAG
TCGGATGATCCCGGACGACCAGCACAGCCCGGATCTCATCCTGCCCCT
GCATGGACTGAGGAACGTCAAAGCCATCGACTATGACCCACTGGACAA
GTTCATCTACTGGGTGGATGGGCGCCAGAACATCAAGCGAGCCAAGGA
CGACGGGACCCAGgcaggtgccctgtgg ......6965 nt......

FIG. 3C

Exon 14 Coordinates: 527d12_Contig309G 44624-44832
ctttgtcttacagCCCTTTGTTTTGACCTCTCTGAGCCAAGGCCAAAACCCAGAC
AGGCAGCCCCACGACCTCAGCATCGACATCTACAGCCGGACACTGTTC
TGGACGTGCGAGGCCACCAATACCATCAACGTCCACAGGCTGAGCGG
GGAAGCCATGGGGGTGGTGCTGCGTGGGGACCGCGACAAGCCCAGGG
CCATCGTCGTCAACGCGGAGCGAGGgtaggaggccaac ……1404 nt…..

Exon 15 Coordinates: 527d12_Contig309G 46236-46427
ccaccctcccgcagGTACCTGTACTTCACCAACATGCAGGACCGGGCAGCCAA
GATCGAACGCGCAGCCCTGGACGGCACCGAGCGCGAGGTCCTCTTCA
CCACCGGCCTCATCCGCCTGTGGCCCTGGTGGTGGACAACACACTGG
GCAAGCTGTTCTGGGTGGACGCGGACCTGAAGCGCATTGAGAGCTGT
GACCTGTCAGgtacgcgccccgg …..686 nt…..

Exon 16 Coordinates: 527d12_Contig309G 47113-47322
ggctgcttgcagGGGCCAACCGCCTGACCCTGGAGGACGCCAACATCGTGCA
GCCTCTGGGCCTGACCATCCTTGGCAAGCATCTCTACTGGATCGACCG
CCAGCAGCAGATGATCGAGCGTGTGGAGAAGACCACCGGGGACAAGC
GGACTCGCATCCAGGGCCGTGTCGCCCACCTCACTGGCATCCATGCAG
TGGAGGAAGTCAGCCTGGAGGAGTTCTgtacgtggggc …..3884 nt……

Exon 17 Coordinates: 527d12_Contig309G 51206-51331
ttgtctttgcagCAGCCCACCCATGTGCCCGTGACAATGGTGGCTGCTCCCACA
TCTGTATTGCCAAGGGTGATGGGACACCACGGTGCTCATGCCCAGTCC
ACCTCGTGCTCCTGCAGAACCTGCTGACCTGTGGAGgtaggtgtgacctaggtgc ….3905 nt…….

Exon 18 Coordinates: 527d12_Contig309G 55236-55472
gttctcctctgtccctcccccagAGCCGCCCACCTGCTCCCCGGACCAGTTTGCATGT
GCCACAGGGGAGATCGACTGTATCCCCGGGGCCTGGCGCTGTGACGG
CTTTCCCGAGTGCGATGACCAGAGCGACGAGGAGGGCTGCCCCGTGT
GCTCCGCCGCCCAGTTCCCCTGCGCGCGGGGTCAGTGTGTGGACCTGC
GCCTGCGCTGCGACGGCGAGGCAGACTGTCAGGACCGCTCAGACGAG
GTGGACTGTGACGgtgaggccctcc …….3052 nt…..

FIG. 3D

Exon 19 Coordinates: 527d12_Contig309G 58524-58634
tctccttgcagCCATCTGCCTGCCCAACCAGTTCCGGTGTGCGAGCGGCCAGT
GTGTCCTCATCAAACAGCAGTGCGACTCCTTCCCCGACTGTATCGACG
GCTCCGACGAGCTCATGTGTGgtgagccagctt ........1448 nt......

Exon 20 Coordinates: 527d12_Contig309G 60082-60319
gtttgtctctggcagAAATCACCAAGCCGCCCTCAGACGACAGCCCGGCCCACA
GCAGTGCCATCGGGCCCGTCATTGGCATCATCCTCTCTCTCTTCGTCAT
GGGTGGTGTCTATTTTGTGTGCCAGCGCGTGGTGTGCCAGCGCTATGC
GGGGGCCAACGGGCCTTCCCGCACGAGTATGTCAGCGGGACCCCGC
ACGTGCCCCTCAATTTCATAGCCCCGGGCGGTTCCCAGCATGGCCCCT
TCACAGgtaaggagcctgagatatggaa ....1095 nt.....

Exon 21 Coordinates: 527d12_Contig309G 61414-61552
cttccctgccagGCATCGCATGCGGAAAGTCCATGATGAGCTCCGTGAGCCTG
ATGGGGGGCCGGGGCGGGGTGCCCCTCTACGACCGGAACCACGTCAC
AGGGGCCTCGTCCAGCAGCTCGTCCAGCACGAAGGCCACGCTGTACCC
GCCGgtgagggggcggg ......6513 nt......

Exon 22 Coordinates: 527d12_Contig309G 68065-68162
ttggctctcctcagATCCTGAACCCGCCGCCCTCCCCGGCCACGGACCCCTCCC
TGTACAACATGGACATGTTCTACTCTTCAAACATTCCGGCCACTGCGA
GACCGTACAGgtaggacatcccctgcag .......2273 nt.....

FIG. 3E

Exon 23 Coordinates: 527d12_Contig309G 70435-70901
tcaaacattccggccactgcgagaccgtacagGCCCTACATCATTCGAGGAATGGCGCCCC
CGACGACGCCCTGCAGCACCGACGTGTGTGACAGCGACTACAGCGCC
AGCCGCTGGAAGGCCAGCAAGTACTACCTGGATTTGAACTCGGACTCA
GACCCCTATCCACCCCCACCCACGCCCCACAGCCAGTACCTGTCGGCG
GAGGACAGCTGCCCGCCCTCGCCCGCCACCGAGAGGAGCTACTTCCAT
CTCTTCCCGCCCCTCCGTCCCCTGCACGGACTCATCC<u>TGACCTCGGC
CGGGCCACTCTGGCTTCTCTGTGCCCCTGTAAATAGTTTTAAATATGAACAA
AGAAAAAAATATATTTTATGATTTAAAAAATAAATATAATTGGGATTTTAA
AAACATGAGAAATGTGAACTGTGATGGGGTGGGCAGGGCTGGGAGAACTT
TGTACAGTGGAGAAATATTTATAAACTTAATTTTGTAAAACA</u>

FIG. 3F

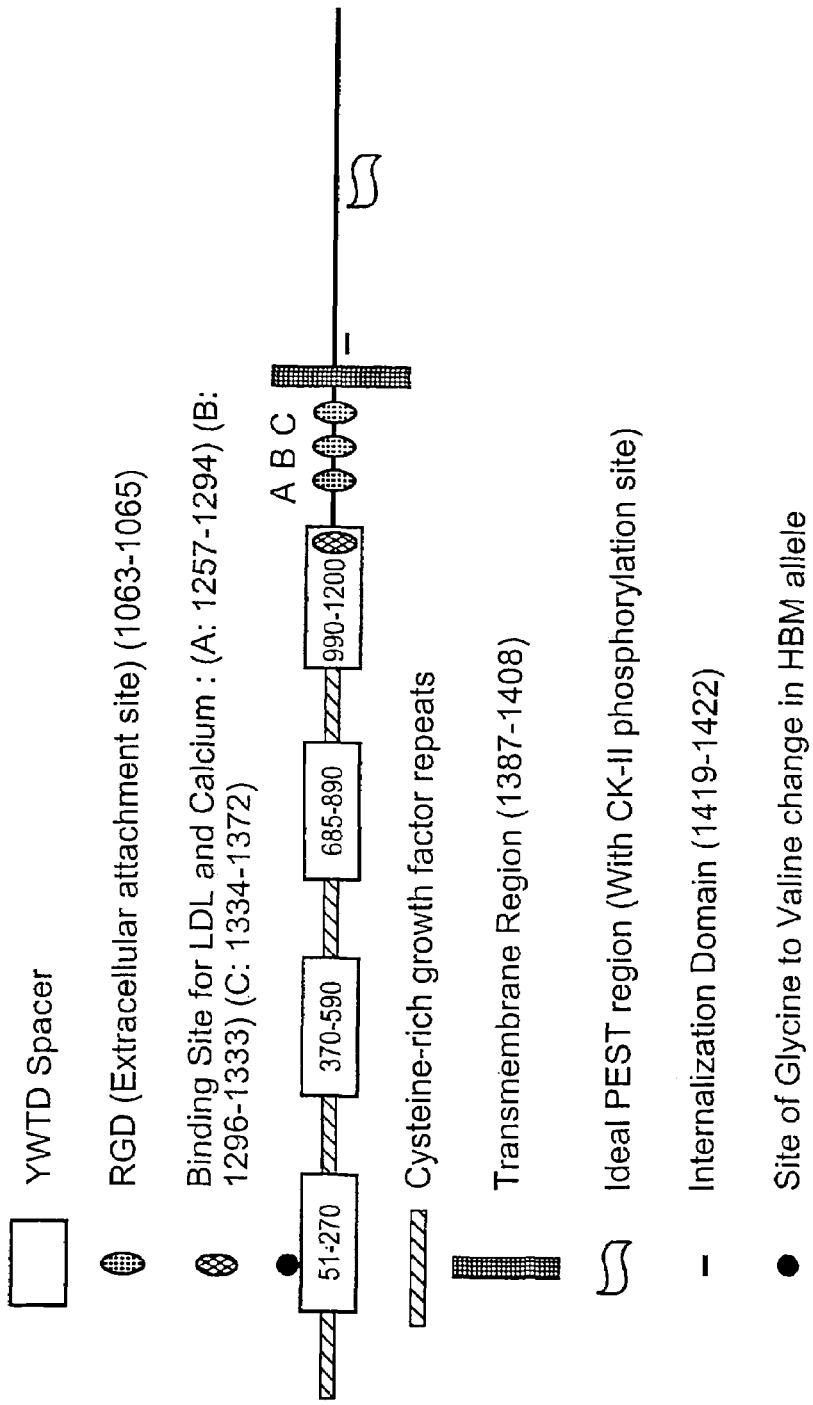

FIG. 6A

```
1    ACTAAAGCGCCCGCCGCCGCGCCGCCATGGAGCCCGAGTGAGCGCGGGCCCGGGCCCGTCCGGCC              60
61   GCCGGACAACATGGAGGCAGCGCCCGCCGCTGCCGCCGCTGCCGCTGCCGCTGCTGCTGCTGCTGCT            120
1         M  E  A  A  P  P  G  P  P  W  P  L  L  L  L  L  L                       17
121  GCTGCTGCTGCTGGCGCTGTGCGGCTGCCCGGCTCCCGCGCTCCGCTCCTGCTATT                      180
18    L  L  L  A  L  C  G  C  P  A  P  A  A  A  S  P  L  L  L  F                   37
181  TGCCAACCGCCGGGACGTACGGCTGGTGGACGCCGGAGTCAAGCTGGAGTCCACCAT                     240
38    A  N  R  R  D  V  R  L  V  D  A  G  G  V  K  L  E  S  T  I                   57
241  CGTGGTCAGCGGCCTGGAGGATGCGGCCGCAGTGGACTTCCAGTTTTCCAAGGGAGCCGT                  300
58    V  V  S  G  L  E  D  A  A  A  V  D  F  Q  F  S  K  G  A  V                   77
301  GTACTGGACAGACGTGAGCGAGGAGGCCATCAAGCAGACCTACCTGAACCAGACGGGGGC                  360
78    Y  W  T  D  V  S  E  E  A  I  K  Q  T  Y  L  N  Q  T  G  A                   97
361  CGCCGTGCAGAACGTGGTCATCTCCGGCCTGGTCTCTCCCGACGGGCCTGCCTGCGACTG                  420
98    A  V  Q  N  V  V  I  S  G  L  V  S  P  D  G  L  A  C  D  W                  117
421  GGTGGGCAAGAAGCTGTACTGGACTGACAGACTCAGAGAACCCGATGGAGGTGGCCAACCT                 480
118   V  G  K  K  L  Y  W  T  D  S  E  T  N  R  I  E  V  A  N  L                  137
481  CAATGGCACATCCCGGAAGGTGCTCTTCTGGCAGGACCTTGACCAGCCGAGGGCCATCGC                  540
138   N  G  T  S  R  K  V  L  F  W  Q  D  L  D  Q  P  R  A  I  A                  157
541  CTTGGACCCCGCTCACGGGTACATGTACTGGACAGACTGGGGTGAGACGCCCCGGATTGA                  600
158   L  D  P  A  H  G  Y  M  Y  W  T  D  W  G  E  T  P  R  I  E                  177
```

FIG. 6B

```
601  GCGGGCAGGGATGGATGGCAGCACCCGGAAGATCATTGTGGACTCGGACATTTACTGGCC  660
178   R  A  G  M  D  G  S  T  R  K  I  I  V  D  S  D  I  Y  W  P   197

661  CAATGGACTGACCATCGACCTGGAGGAGCAGAAGCTCTACTGGGCTGACGCCAAGCTCAG  720
198   N  G  L  T  I  D  L  E  E  Q  K  L  Y  W  A  D  A  K  L  S   217

721  CTTCATCCACCGTGCCAACCTGGACGGCTCGTTCCGGCAGAAGGTGGTGGAGGGCAGCCT  780
218   F  I  H  R  A  N  L  D  G  S  F  R  Q  K  V  V  E  G  S  L   237

781  GACGCACCCCTTCGCCCTGACGCTCTCCGGGGACACTCTGTACTGGACAGACTGGCAGAC  840
238   T  H  P  F  A  L  T  L  S  G  D  T  L  Y  W  T  D  W  Q  T   257

841  CCGCTCCATCCATGCCTGCAACAAGCGCACTGGGGGAAGAGGAAGGAGATCCTGAGTGC  900
258   R  S  I  H  A  C  N  K  R  T  G  G  K  R  K  E  I  L  S  A   277

901  CCTCTACTCACCCATGGACATCCAGGTGCTGAGCCAGGAGCGGCAGCCTTTCTTCCACAC  960
278   L  Y  S  P  M  D  I  Q  V  L  S  Q  E  R  Q  P  F  F  H  T   297

961  TCGCTGTGAGGAGGACAATGGCGGCTGCTCCCACCTGTGCCTGCTGTCCCCAAGCGAGCC  1020
298   R  C  E  E  D  N  G  G  C  S  H  L  C  L  L  S  P  S  E  P   317

1021 TTTCTACACATGCGCCTGCCCCACGGGTGTGCAGCTGCAGGACAACGGCAGGACTGTGTAA 1080
318   F  Y  T  C  A  C  P  T  G  V  Q  L  Q  D  N  G  R  T  C  K   337

1081 GGCAGGAGCCGAGGAGGTGCTGCTGGCCCGGCGACGACCTACGGAGGATCTCGCT      1140
338   A  G  A  E  E  V  L  L  L  A  R  R  T  D  L  R  R  I  S  L   357
```

FIG. 6C

```
1141  GGACACGCCCGGACTTCACCGACATCGTGCTGCAGGTGGACGACGACATCCGGCACGCCATTGC  1200
358    D  T  P  D  F  T  D  I  V  L  Q  V  D  D  D  I  R  H  A  I  A     377

1201  CATCGACTACGACCCGCTAGAGGGCTATGTCTACTGGACAGATGACGAGGTGCGGGCCAT      1260
378    I  D  Y  D  P  L  E  G  Y  V  Y  W  T  D  D  E  V  R  A  I         397

1261  CCGCAGGGCGTACCTGGACGGGTCTGGGGCGCAGGCTCAACACCGAGATCAACGA           1320
398    R  R  A  Y  L  D  G  S  G  A  Q  T  L  V  N  T  E  I  N  D         417

1321  CCCCGATGGCATCGCGGTCGACTGGGTGGCCGAAACCTCTACTGGACCGACACGGGCAC       1380
418    P  D  G  I  A  V  D  W  V  A  R  N  L  Y  W  T  D  T  G  T        437

1381  GGACCGCATCGAGGTGACGCGCCTCAACGGCACCTCCCGCAAGATCCTGGTGTCGGAGGA     1440
438    D  R  I  E  V  T  R  L  N  G  T  S  R  K  I  L  V  S  E  D        457

1441  CCTGGACGAGCCCCGAGCCATCGCACTGCACCCCGTGATGGGCCTCATGTACTGGACAGA     1500
458    L  D  E  P  R  A  I  A  L  H  P  V  M  G  L  M  Y  W  T  D         477

1501  CTGGGGAGAGAACCCTAAAATCGAGTGTGCCAACTTGGATGGGCAGGAGCGGCGTGTGCT     1560
478    W  G  E  N  P  K  I  E  C  A  N  L  D  G  Q  E  R  R  V  L        497

1561  GGTCAATGCCTCTCCCTCGGGTGGCCCAACGGCCTGGCCCTGGACCTGCAGGAGGGGAAGCT   1620
498    V  N  A  S  L  G  W  P  N  G  L  A  L  D  L  Q  E  G  K  L        517

1621  CTACTGGGGAGACGCCAAGACAGACAAGATCGAGGTGATCAATGTTGATGGGACGAAGAG     1680
518    Y  W  G  D  A  K  T  D  K  I  E  V  I  N  V  D  G  T  K  R        537
```

FIG. 6D

```
1681  GCGGACCCTCCTGGAGGACAAGCTCCCGCACATTTCGGGTTCACGCTGCTGGGGACTT  1740
538    R  T  L  L  E  D  K  L  P  H  I  F  G  F  T  L  L  G  D  F    557

1741  CATCTACTGGACTGACTGGCAGCGCCCAGCATCGAGCGGGTGCACAAGGTCAAGGCCAG  1800
558    I  Y  W  T  D  W  Q  R  R  S  I  E  R  V  H  K  V  K  A  S    577

1801  CCGGGACGTCATCATTGACCAGCTGCCCGACCTGATGGGGCTCAAAGCTGTGAATGTGGC  1860
578    R  D  V  I  I  D  Q  L  P  D  L  M  G  L  K  A  V  N  V  A    597

1861  CAAGGTCGTCGGAACAAACCCGTGTGCGGACAGGAACGGGGGTGCAGCCACCTGTGCTT  1920
598    K  V  V  G  T  N  P  C  A  D  R  N  G  G  C  S  H  L  C  F    617

1921  CTTCACACCCCACGCAAACCCGGTGTGGCTGCCCCATCGGCCTGGAGCTGCTGAGTGACAT  1980
618    F  T  P  H  A  T  R  C  G  C  P  I  G  L  E  L  L  S  D  M    637

1981  GAAGACCTGCATCGTGCCTGAGGCCTTCTTGGTCTTCACCAGCAGAGCCGCCATCCACAG  2040
638    K  T  C  I  V  P  E  A  F  L  V  F  T  S  R  A  A  I  H  R    657

2041  GATCTCCCTCGAGACCAATAACAACGACGTGGCCATCCCGCTCACGGGCGTCAAGGAGGC  2100
658    I  S  L  E  T  N  N  N  D  V  A  I  P  L  T  G  V  K  E  A    677

2101  CTCAGCCCTGGACTTTGATGTGTCCAACAACCACATCTACTGGACAGACGTCAGCCTGAA  2160
678    S  A  L  D  F  D  V  S  N  N  H  I  Y  W  T  D  V  S  L  K    697

2161  GACCATCAGCCGCCTTCATGAACGGGAGCTCGGTGGAGCACGTGGTGGAGTTTGGCCT  2220
698    T  I  S  R  A  F  M  N  G  S  S  V  E  H  V  V  E  F  G  L    717
```

FIG. 6E

```
2221  TGACTACCCCGAGGGCATGGCCGTTGACTGGATGGGCAAGAACCTCTACTGGGCCGACAC   2280
 718   D  Y  P  E  G  M  A  V  D  W  M  G  K  N  L  Y  W  A  D  T    737

2281  TGGGACCAACAGAATCGAAGTGGCGCGGCTGGACGGGCAGTTCCGGCAAGTCCTCGTGTG   2340
 738   G  T  N  R  I  E  V  A  R  L  D  G  Q  F  R  Q  V  L  V  W    757

2341  GAGGGACTTGGACAACCCGAGTCGCTGGCCCTGGATCCACCAAGGGCTACATCTACTG    2400
 758   R  D  L  D  N  P  R  S  L  A  L  D  P  T  K  G  Y  I  Y  W    777

2401  GACCGAGTGGGGCGGCAAGCCGAGGATCGTGCGGGCCTTCATGGACGGGACCAACTGCAT   2460
 778   T  E  W  G  G  K  P  R  I  V  R  A  F  M  D  G  T  N  C  M    797

2461  GACGCTGGTGGACAAGGTGGGCCGGGCCAACGACCTCACCATTGACTACGCTGACCAGCG   2520
 798   T  L  V  D  K  V  G  R  A  N  D  L  T  I  D  Y  A  D  Q  R    817

2521  CCTCTACTGGACCGACCTGGACACCAACATGATCGAGTCGTCCAACATGCTGGGTCAGGA   2580
 818   L  Y  W  T  D  L  D  T  N  M  I  E  S  S  N  M  L  G  Q  E    837

2581  GCGGGTCGTGATTGCCGACGATCTCCCGCACCCCGTTCGGTCTGACGCAGTACAGCGATTA   2640
 838   R  V  V  I  A  D  D  L  P  H  P  F  G  L  T  Q  Y  S  D  Y    857

2641  TATCTACTGGACAGACTGGAATCTGCACAGCATTGAGCGGGCCGACAAGACTAGCGGCCG   2700
 858   I  Y  W  T  D  W  N  L  H  S  I  E  R  A  D  K  T  S  G  R    877

2701  GAACCCGCACCCTCATCCAGGGCCACCTGGACTTCGTGATGGACATCCTGGTGTTCCACTC   2760
 878   N  R  T  L  I  Q  G  H  L  D  F  V  M  D  I  L  V  F  H  S    897
```

FIG. 6F

```
2761  CTCCCGCCAGGATGGCCCTCAATGACTGTATGCACAACGGGCAGTGTGGGCAGCTGTG  2820
 898   S   R   Q   D   G   L   N   D   C   M   H   N   N   G   Q   C   G   Q   L   C    917

2821  CCTTGCCATCCCCGGGGCCACCGTGCGCCTGCGCTGCACACTACACCCTGGACCCCAG  2880
 918   L   A   I   P   G   G   H   R   C   G   C   A   S   H   Y   T   L   D   P   S    937

2881  CAGCCGCAACTGCAGCCCGCCCACCACCTTCTTGCTGTTCAGCCAGAAATCTGCCATCAG  2940
 938   S   R   N   C   S   P   P   T   T   F   L   L   F   S   Q   K   S   A   I   S    957

2941  TCGGATGATCCCGGACGACCAGCACACAGCCCGGATCTCATCCTGCCCCCTGCATGGACTGAG  3000
 958   R   M   I   P   D   D   Q   H   S   P   D   L   I   L   P   L   H   G   L   R    977

3001  GAACGTCAAAGCCATCGACTATGACCCTGGACAAGTTCATCTACTGGGTGGATGGGCG  3060
 978   N   V   K   A   I   D   Y   D   P   L   D   K   F   I   Y   W   V   D   G   R    997

3061  CCAGAACATCAAGCGAGCCAAGGACGACGGGACCCAGCCCTTTGTTTTGACCTCTCTGAG  3120
 998   Q   N   I   K   R   A   K   D   D   G   T   Q   P   F   V   L   T   S   L   S    1017

3121  CCAAGGCCAAAACCCAGACGACCAGCCCCACGACCTCAGCATCGACATCTACAGCCGGAC  3180
1018   Q   G   Q   N   P   D   R   Q   P   H   D   L   S   I   D   I   Y   S   R   T    1037

3181  ACTGTTCTGGACGTGCGAGGCCACAATACCATCAACGTCCACAGGCTGAGCGGGGAAGC  3240
1038   L   F   W   T   C   E   A   T   N   T   I   N   V   H   R   L   S   G   E   A    1057

3241  CATGGGGGTGGTGCTGCGTGGGGACCGCGACAAGCCCAGGGCCATCGTCGTCAACGCCGGA  3300
1058   M   G   V   V   L   R   G   D   R   D   K   P   R   A   I   V   V   N   A   E    1077
```

FIG. 6G

```
3301 GCGAGGGTACCTGTACTTCACCAACATGCAGGACCGGGCAGCCAAGATCGAACGCGCAGC 3360
1078  A  R  G  Y  L  Y  F  T  N  M  Q  D  R  A  A  K  I  E  R  A  A   1097

3361 CCTGGACGGCACCGAGCGCGAGGTCCTCTTCACCACCGGCCTCATCCGGCCCGTGGCCCT 3420
1098  L  D  G  T  E  R  E  V  L  F  T  T  G  L  I  R  P  V  A  L   1117

3421 GGTGGTGGACAACACACTGGGCAAGCTGTTCTGGGTGGACCTGAAGCGCATTGA 3480
1118  V  V  D  N  T  L  G  K  L  F  W  V  D  A  D  L  K  R  I  E   1137

3481 GAGCTGTGACCTGTCAGGGGCCAACCGCCTGACCCTGGAGGACGCCAACATCGTGCAGCC 3540
1138  S  C  D  L  S  G  A  N  R  L  T  L  E  D  A  N  I  V  Q  P   1157

3541 TCTGGGCCTGACCATCCTTGGCAAGCATCTCTACTGGATCGACAGCAGCAGATGAT 3600
1158  L  G  L  T  I  L  G  K  H  L  Y  W  I  D  R  Q  Q  Q  M  I   1177

3601 CGAGCGTGTGGAGAAGACCACCGGGGACAAGCGGACTCGCATCCAGGGCCGTGTCGCCCA 3660
1178  E  R  V  E  K  T  T  G  D  K  R  T  R  I  Q  G  R  V  A  H   1197

3661 CCTCACTGGCATCCATGCCAGTGGAGGAAGTCAGCCTGGAGGAGTTCTCAGCCCACCATG 3720
1198  L  T  G  I  H  A  V  E  E  V  S  L  E  E  F  S  A  H  P  C   1217

3721 TGCCCGTGACAATGGTGGCTGCTCCCACATCTGTATTGCCAAGGGTGATGGGACACCACG 3780
1218  A  R  D  N  G  G  C  S  H  I  C  I  A  K  G  D  G  T  P  R   1237

3781 GTGCTCATGCCCAGTCCACCTGTCCTGCAGAACCTGCTGACCTGTGGAGAGCCCGCC 3840
1238  C  S  C  P  V  H  L  V  L  L  Q  N  L  L  T  C  G  E  P  P   1257
```

FIG. 6H

```
3841  CACCTGCTCCCCGGACCAGTTTGCATGTGCCACAGGGGAGATCGACTGTATCCCCGGGGC  3900
1258   T  C  S  P  D  Q  F  A  C  A  T  G  E  I  D  C  I  P  G  A   1277

3901  CTGGGCGCTGTGACGGCTTTCCCGAGTGCGATGACCAGAGCGACGAGGAGGGCTGCCCCGT  3960
1278   W  R  C  D  G  F  P  E  C  D  D  Q  S  D  E  E  G  C  P  V   1297

3961  GTGCTCCGCCGCCCAGTTCCCCTGCGCGCGGGGTCAGTGTGTGGACCTGCGCCTGCGCTG  4020
1298   C  S  A  A  Q  F  P  C  A  R  G  Q  C  V  D  L  R  L  R  C   1317

4021  CGACGGGCGAGGCAGACTGTCAGGACCGCTCAGACGAGGTGGACTGTGACGCCATCTGCCT  4080
1318   D  G  E  A  D  C  Q  D  R  S  D  E  V  D  C  D  A  I  C  L   1337

4081  GCCCAACCAGTTCCGGTGTGCCAGCGGCCAGTGTGTCCTCATCAAACAGCAGTGCGACTC  4140
1338   P  N  Q  F  R  C  A  S  G  Q  C  V  L  I  K  Q  Q  C  D  S   1357

4141  CTTCCCCGACTGTATCGACGGCTCCGACGAGCTCATGTGTGAAATCACCAAGCCGCCCTC  4200
1358   F  P  D  C  I  D  G  S  D  E  L  M  C  E  I  T  K  P  P  S   1377

4201  AGACGACAGCCCGGCCCACAGCAGTGCCATCGGGCCCGTCATTGGCATCATCCTCTCTCT  4260
1378   D  D  S  P  A  H  S  S  A  I  G  P  V  I  G  I  I  L  S  L   1397

4261  CTTCGTCATGGGTGTGTGTCTATTTTGTGTGCCAGCGCGTGGTGTGCCAGCGCTATGCGGG  4320
1398   F  V  M  G  G  V  Y  F  V  C  Q  R  V  V  C  Q  R  Y  A  G   1417

4321  GGCCAACGGGCCCTTCCCCGACGAGTATGTCAGCGGGACCCCGCACGTGCCCCTCAATTT  4380
1418   A  N  G  P  F  P  H  E  Y  V  S  G  T  P  H  V  P  L  N  F   1437
```

FIG. 61

```
4381  CATAGCCCCGGGCGGTTCCCAGCATGGCCCCTTCACAGGCATGCGGAAAGTCCAT  4440
1438   I   A   P   G   G   V   P   Q   H   G   P   F   T   G   I   A   C   G   K   S   M    1457

4441  GATGAGCTCCGTGAGCCTGATGGGGCGCGGGGTGCCCCTCTACGACCGGAACCA  4500
1458   M   S   S   V   S   L   M   G   G   R   G   G   V   P   L   Y   D   R   N   H    1477

4501  CGTCACAGGGGCCTCGTCCAGCAGCTCGTCCAGCACGAAGGCCACGCTGTACCCGCCGAT  4560
1478   V   T   G   A   S   S   S   S   S   T   K   A   T   L   Y   P   P   I    1497

4561  CCTGAACCCGCCGCCCCCCGGCCCCTCCCCGGCCACGGACCCCTCCCTGTACAACATGGACATGTTCTA  4620
1498   L   N   P   P   P   S   P   A   T   D   P   S   L   Y   N   M   D   M   F   Y    1517

4621  CTCTTTCAAACATTCCGGCCCTACACAGGCCCTACATCATTCGAGGAATGGC  4680
1518   S   S   N   I   P   A   T   A   R   P   Y   R   P   Y   I   I   R   G   M   A    1537

4681  GCCCCCGACGACGCCCTGCAGCACCGACGTGTGCGACTACAGCGACTACAGCGCCAGCCGCTG  4740
1538   P   P   T   T   P   C   S   T   D   V   C   D   S   D   Y   S   A   S   R   W    1557

4741  GAAGGCCAGCAAGTACTACCTGGATTTGAACTCGGACTCAGACCCCTATCCACCCCCACC  4800
1558   K   A   S   K   Y   Y   L   D   L   N   S   D   S   D   P   Y   P   P   P   P    1577

4801  CACGCCCCACAGCCAGTACCTGTCGGCGGAGGACAGCTGCCCCCCGTCGCCCGCCACCGA  4860
1578   T   P   H   S   Q   Y   L   S   A   E   D   S   C   P   P   S   P   A   T   E    1597

4861  GAGGAGCTACTTCCATCTCTTCCCGCCCCCGCCCTCCGTCCCCTGCACGGACTCATCCTGACC  4920
1598   R   S   Y   F   H   L   F   P   P   P   P   S   P   C   T   D   S   S    1615
```

FIG. 6J

```
4921  TCGGCCCGGGCCACTCTCTGGCTTCTCTGTGCCCCTGTAAATATGAACAAAGA   4980
4981  AAAAATATATTTTATGATTTAAAAAATATAATATTGGGATTTAAAACATGAGAAA  5040
5041  TGTGAACTGTGATGGGGTGGGCAGGGCTGGGAGAACTTTGTACAGTGGAGAAATATTTAT  5100
5101  AAACTTAATTTTGTAAAACA   5120
```

Mouse Zmax1 In situ hybridization
100X Magnification
Antisense probe

Mouse Zmax1 In situ hybridization
100X Magnification
Sense probe

Mouse Zmax1 In situ hybridization
400X Magnification
Antisense probe

Proximal Metaphysis

Osteoblasts and osteoclasts

Trabecular bone

Mouse Zmax1 In situ hybridization
400X Magnification
Sense probe

Mouse Zmax1 In situ hybridization
400X Magnification
Antisense probe

Osteoblasts — Endosteum

Mouse Zmax1 In situ hybridization
400X Magnification
Sense probe

HBM: Constructs for transgenic mice
Confirmation of expression
*Transient transfection into HOB-02-02 cells\**

| CMV βActin | | Type I collagen | |
|---|---|---|---|
| HBM | Zmax1 | HBM | Zmax1 |
| X 1,000 | X 1,000 | X 10 | X 10 |

*\*Fold increase compared to Zmax1 in cells transfected with empty vector*

FIG. 17

HBM: Transgenic mice
*mRNA expression by Taqman analysis**

| Line | Tibia | Femur | Heart | Gonad | Brain | Kidney | Liver |
|------|-------|-------|-------|-------|-------|--------|-------|
| HBMMCBA | | | | | | | |
| 2 | 7-10 | | 20-90 | 2-30 | 6-11 | 5-9 | <1 |
| 13 | 1-2 | | 6-7 | 3-4 | 5-6 | <1 | <1 |
| 18 | 10-11 | | | | | | |
| HBMMTIC | | | | | | | |
| 19 | 7-8 | 19-20 | 1 | | | | 1 |
| 35 | 1 | 1 | 0 | | | | 0 |

* relative to Zmax1 in HOB-03-C5

HBM transgenic mice: in vivo pDXA*
*BMD % changes vs WT in 5 week old animals*

| Line | n | Femur | Spine | Total | Tibia mRNA |
|---|---|---|---|---|---|
| HBMMCBA | | | | | |
| 2 | 11 | 21 | 24 | 10 | x7-10 |
| 13 | 4 | 11 | 27 | 5 | x1-2 |
| 18 | 1 | 8 | 9 | 3 | x10-11 |
| 21 | 1 | 10 | 12 | 6 | 0 |
| 28 | 15 | 0 | 30 | 4 | x1 |
| 30 | 7 | 4 | 32 | 4 | 0 |
| HBMMTIC | | | | | |
| 19 | 5 | 63 | 70 | 41 | x7-8 |
| 35 | 1 | 4 | 47 | 6 | x1 |

* CV: Femur (2.7%); Spine (6.4%); Total (1.7%)

FIG. 22

HBM transgenic mice: in vivo pDXA*
*BMD % changes vs WT in 9 week old animals*

| Line | n | Femur | Spine | Total |
|---|---|---|---|---|
| HBMMCBA | | | | |
| 2 | 3 | 19 | 32 | 12 |
| HBMMTIC | | | | |
| 19 | 2 | 52 | 64 | 37 |
| 35 | 3 | 32 | 43 | 18 |

* CV: Femur (2.7%); Spine (6.4%); Total (1.7%)

HBMGI_2AS

```
TCTAGACTCG AGGCGGCCGC CCATTGTGCA CTAAAGCGCC GCCGCCGCGC CATGGAGCCC
GAGTGAGCGC GGCGCGGGCC CGTCCGGCCG CCGGACAACA TGGAGGCAGC GCCGCCCGGG
CCGCCGTGGC CGCTGCTGCT GCTGCTGCTG CTGCTGCTGG CGCTGTGCGG CTGCCCGGCC
CCCGCCGCGG CCTCGCCGCT CCTGCTATTT GCCAACCGCC GGGACGTACG GCTGGTGGAC
GCCGGCGGAG TCAAGCTGGA GTCCACCATC GTGGTCAGCG GCCTGGAGGA TGCGGCCGCA
GTGGACTTCC AGTTTTCCAA GGGAGCCGTG TACTGGACAG ACGTGAGCGA GGAGGCCATC
AAGCAGACCT ACCTGAACCA GACGGGGGCC GCCGTGCAGA ACGTGGTCAT CTCCGGCCTG
GTCTCTCCCG ACGGCCTCGC CTGCGACTGG GTGGGCAAGA AGCTGTACTG GACGGACTCA
GAGACCAACC GCATCGAGGT GGCCAACCTC AATGGCACAT CCCGGAAGGT GCTCTTCTGG
CAGGACCTTG ACCAGCCGAG GGCCATCGCC TTGGACCCCG CTCACGGGTA CATGTACTGG
ACAGACTGGG TTGAGACGCC CCGGATTGAG CGGGCAGGGA TGGATGGCAG CACCCGGAAG
ATCATTGTGG ACTCGGACAT TTACTGGCCC AATGGACTGA CCATCGACCT GGAGGAGCAG
AAGCTCTACT GGGCTGACGC CAAGCTCAGC TTCATCCACC GTGCCAACCT GGACGGCTCG
TTCCGGCAGA AGGTGGTGGA GGGCAGCCTG ACGCACCCCT TCGCCCTGAC GCTCTCCGGG
GACACTCTGT ACTGGACAGA CTGGCAGACC CGCTCCATCC ATGCCTGCAA CAAGCGCACT
GGGGGGAAGA GGAAGGAGAT CCTGAGTGCC CTCTACTCAC CCATGGACAT CCAGGTGCTG
AGCCAGGAGC GGCAGCCTTT CTTCCACACT CGCTGTGAGG AGGACAATGG CGGCTGCTCC
CACCTGTGCC TGCTGTCCCC AAGCGAGCCT TTCTACACAT GCGCCTGCCC CACGGGTGTG
CAGCTGCAGG ACAACGGCAG GACGTGTAAG GCAGGAGCCG AGGAGGTGCT GCTGCTGGCC
CGGCGGACGG ACCTACGGAG GATCTCGCTG GACACGCCGG ACTTCACCGA CATCGTGCTG
CAGGTGGACG ACATCCGGCA CGCCATTGCC ATCGACTACG ACCCGCTAGA GGGCTATGTC
TACTGGACAG ATGACGAGGT GCGGGCCATC CGCAGGGCGT ACCTGGACGG GTCTGGGGCG
CAGACGCTGG TCAACACCGA GATCAACGAC CCCGATGGCA TCGCGGTCGA CTGGGTGGCC
CGAAACCTCT ACTGGACCGA CACGGGCACG GACCGCATCG AGGTGACGCG CCTCAACGGC
```

FIG. 24B

HBMGI_2AS

```
ACCTCCCGCA AGATCCTGGT GTCGGAGGAC CTGGACGAGC CCCGAGCCAT CGCACTGCAC
CCCGTGATGG GCCTCATGTA CTGGACAGAC TGGGGAGAGA ACCCTAAAAT CGAGTGTGCC
AACTTGGATG GGCAGGAGCG GCGTGTGCTG GTCAATGCCT CCCTCGGGTG GCCCAACGGC
CTGGCCCTGG ACCTGCAGGA GGGGAAGCTC TACTGGGGAG ACGCCAAGAC AGACAAGATC
GAGGTGATCA ATGTTGATGG GACGAAGAGG CGGACCCTCC TGGAGGACAA GCTCCCGCAC
ATTTTCGGGT TCACGCTGCT GGGGGACTTC ATCTACTGGA CTGACTGGCA GCGCCGCAGC
ATCGAGCGGG TGCACAAGGT CAAGGCCAGC CGGGACGTCA TCATTGACCA GCTGCCCGAC
CTGATGGGGC TCAAAGCTGT GAATGTGGCC AAGGTCGTCG GAACCAACCC GTGTGCGGAC
AGGAACGGGG GGTGCAGCCA CCTGTGCTTC TTCACACCCC ACGCAACCCG GTGTGGCTGC
CCCATCGGCC TGGAGCTGCT GAGTGACATG AAGACCTGCA TCGTGCCTGA GGCCTTCTTG
GTCTTCACCA GCAGAGCCGC CATCCACAGG ATCTCCCTCG AGACCAATAA CAACGACGTG
GCCATCCCGC TCACGGGCGT CAAGGAGGCC TCAGCCCTGG ACTTTGATGT GTCCAACAAC
CACATCTACT GGACAGACGT CAGCCTGAAG ACCATCAGCC GCGCCTTCAT GAACGGGAGC
TCGGTGGAGC ACGTGGTGGA GTTTGGCCTT GACTACCCCG AGGGCATGGC CGTTGACTGG
ATGGGCAAGA ACCTCTACTG GGCCGACACT GGGACCAACA GAATCGAAGT GGCGCGGCTG
GACGGGCAGT CCGGCAAGT CCTCGTGTGG AGGGACTTGG ACAACCCGAG GTCGCTGGCC
CTGGATCCCA CCAAGGGCTA CATCTACTGG ACCGAGTGGG GCGGCAAGCC GAGGATCGTG
CGGGCCTTCA TGGACGGGAC CAACTGCATG ACGCTGGTGG ACAAGGTGGG CCGGGCCAAC
GACCTCACCA TTGACTACGC TGACCAGCGC CTCTACTGGA CCGACCTGGA CACCAACATG
ATCGAGTCGT CCAACATGCT GGGTCAGGAG CGGGTCGTGA TTGCCGACGA TCTCCCGCAC
CCGTTCGGTC TGACGCAGTA CAGCGATTAT ATCTACTGGA CAGACTGGAA TCTGCACAGC
ATTGAGCGGG CCGACAAGAC TAGCGGCCGG AACCGCACCC TCATCCAGGG CCACCTGGAC
TTCGTGATGG ACATCCTGGT GTTCCACTCC TCCCGCCAGG ATGGCCTCAA TGACTGTATG
```

FIG. 24C

HBMGI_2AS

```
CACAACAACG GGCAGTGTGG GCAGCTGTGC CTTGCCATCC CCGGCGGCCA CCGCTGCGGC
TGCGCCTCAC ACTACACCCT GGACCCCAGC AGCCGCAACT GCAGCCCGCC CACCACCTTC
TTGCTGTTCA GCCAGAAATC TGCCATCAGT CGGATGATCC CGGACGACCA GCACAGCCCG
GATCTCATCC TGCCCCTGCA TGGACTGAGG AACGTCAAAG CCATCGACTA TGACCCACTG
GACAAGTTCA TCTACTGGGT GGATGGGCGC CAGAACATCA AGCGAGCCAA GGACGACGGG
ACCCAGCCCT TTGTTTTGAC CTCTCTGAGC CAAGGCCAAA ACCCAGACAG GCAGCCCCAC
GACCTCAGCA TCGACATCTA CAGCCGGACA CTGTTCTGGA CGTGCGAGGC CACCAATACC
ATCAACGTCC ACAGGCTGAG CGGGGAAGCC ATGGGGGTGG TGCTGCGTGG GGACCGCGAC
AAGCCCAGGG CCATCGTCGT CAACGCGGAG CGAGGGTACC TGTACTTCAC CAACATGCAG
GACCGGGCAG CCAAGATCGA ACGCGCAGCC CTGGACGGCA CCGAGCGCGA GGTCCTCTTC
ACCACCGGCC TCATCCGCCC TGTGGCCCTG GTGGTAGACA CACACTGGG CAAGCTGTTC
TGGGTGGACG CGGACCTGAA GCGCATTGAG AGCTGTGACC TGTCAGGGGC CAACCGCCTG
ACCCTGGAGG ACGCCAACAT CGTGCAGCCT CTGGGCCTGA CCATCCTTGG CAAGCATCTC
TACTGGATCG ACCGCCAGCA GCAGATGATC GAGCGTGTGG AGAAGACCAC CGGGGACAAG
CGGACTCGCA TCCAGGGCCG TGTCGCCCAC CTCACTGGCA TCCATGCAGT GGAGGAAGTC
AGCCTGGAGG AGTTCTCAGC CCACCCATGT GCCCGTGACA ATGGTGGCTG CTCCCACATC
TGTATTGCCA AGGGTGATGG GACACCACGG TGCTCATGCC CAGTCCACCT CGTGCTCCTG
CAGAACCTGC TGACCTGTGG AGAGCCGCCC ACCTGCTCCC CGGACCAGTT TGCATGTGCC
ACAGGGGAGA TCGACTGTAT CCCCGGGGCC TGGCGCTGTG ACGGCTTTCC CGAGTGCGAT
GACCAGAGCG ACGAGGAGGG CTGCCCCGTG TGCTCCGCCG CCCAGTTCCC CTGCGCGCGG
GGTCAGTGTG TGGACCTGCG CCTGCGCTGC GACGGCGAGG CAGACTGTCA GGACCGCTCA
GACGAGGCGG ACTGTGACGC CATCTGCCTG CCCAACCAGT TCCGGTGTGC GAGCGGCCAG
TGTGTCCTCA TCAAACAGCA GTGCGACTCC TTCCCCGACT GTATCGACGG CTCCGACGAG
CTCATGTGTG AAATCACCAA GCCGCCCTCA GACGACAGCC CGGCCCACAG CAGTGCCATC
```

FIG. 24D

HBMGI_2AS

```
GGGCCCGTCA TTGGCATCAT CCTCTCTCTC TTCGTCATGG GTGGTGTCTA TTTTGTGTGC
CAGCGCGTGG TGTGCCAGCG CTATGCGGGG GCCAACGGGC CCTTCCCGCA CGAGTATGTC
AGCGGGACCC CGCACGTGCC CCTCAATTTC ATAGCCCCGG GCGGTTCCCA GCATGGCCCC
TTCACAGGCA TCGCATGCGG AAAGTCCATG ATGAGCTCCG TGAGCCTGAT GGGGGGCCGG
GGCGGGGTGC CCCTCTACGA CCGGAACCAC GTCACAGGGG CCTCGTCCAG CAGCTCGTCC
AGCACGAAGG CCACGCTGTA CCCGCCGATC CTGAACCCGC CGCCCTCCCC GGCCACGGAC
CCCTCCCTGT ACAACATGGA CATGTTCTAC TCTTCAAACA TTCCGGCCAC TGCGAGACCG
TACAGGCCCT ACATCATTCG AGGAATGGCG CCCCGACGA CGCCCTGCAG CACCGACGTG
TGTGACAGCG ACTACAGCGC CAGCCGCTGG AAGGCCAGCA AGTACTACCT GGATTTGAAC
TCGGACTCAG ACCCCTATCC ACCCCCACCC ACGCCCCACA GCCAGTACCT GTCGGCGGAG
GACAGCTGCC CGCCCTCGCC CGCCACCGAG AGGAGCTACT CCATCTCTT CCCGCCCCCT
CCGTCCCCCT GCACGGACTC ATCCTGACCT CGGCCGGGCC ACTCTGGCTT CTCTGTGCCC
CTGTAAATAG TTTTAAATAT GAACAAAGAA AAAAATATAT TTTATGATTT AAAAAATAAA
TATAATTGGG ATTTTAAAAA CATGAGAAAT GTGAACTGTG ATGGGGTGGG CAGGGCTGGG
AGAACTTTGT ACAGTGGAGA AATATTTATA AACTTAATTT TGTAAAACAG AAAAAAAAAA
AAAAAAAAAA AAAAAAAAAA AAAAAAAAAA AAAAAAAAAA AAAAAAAAAA AAAAAAAAAA
AAAAAAAAAA AAAAAAAAAA AAAAAAAAAA AAAAAAAAAA AAAAAAAAAA GCGGCCGC
```

FIG. 25A

ZMAXGI_3AS

```
TCTAGACTCG AGGCGGCCGC CCATTGTGCA CTAAAGCGCC GCCGCCGCGC CATGGAGCCC
GAGTGAGCGC GGCGCGGGCC CGTCCGGCCG CCGGACAACA TGGAGGCAGC GCCGCCCGGG
CCGCCGTGGC CGCTGCTGCT GCTGCTGCTG CTGCTGCTGG CGCTGTGCGG CTGCCCGGCC
CCCGCCGCGG CCTCGCCGCT CCTGCTATTT GCCAACCGCC GGGACGTACG GCTGGTGGAC
GCCGGCGGAG TCAAGCTGGA GTCCACCATC GTGGTCAGCG GCCTGGAGGA TGCGGCCGCA
GTGGACTTCC AGTTTTCCAA GGGAGCCGTG TACTGGACAG ACGTGAGCGA GGAGGCCATC
AAGCAGACCT ACCTGAACCA GACGGGGGCC GCCGTGCAGA ACGTGGTCAT CTCCGGCCTG
GTCTCTCCCG ACGGCCTCGC CTGCGACTGG GTGGGCAAGA AGCTGTACTG GACGGACTCA
GAGACCAACC GCATCGAGGT GGCCAACCTC AATGGCACAT CCCGGAAGGT GCTCTTCTGG
CAGGACCTTG ACCAGCCGAG GGCCATCGCC TTGGACCCCG CTCACGGGTA CATGTACTGG
ACAGACTGGG GTGAGACGCC CCGGATTGAG CGGGCAGGGA TGGATGGCAG CACCCGGAAG
ATCATTGTGG ACTCGGACAT TTACTGGCCC AATGGACTGA CCATCGACCT GGAGGAGCAG
AAGCTCTACT GGGCTGACGC CAAGCTCAGC TTCATCCACC GTGCCAACCT GGACGGCTCG
TTCCGGCAGA AGGTGGTGGA GGGCAGCCTG ACGCACCCCT TCGCCCTGAC GCTCTCCGGG
GACACTCTGT ACTGGACAGA CTGGCAGACC CGCTCCATCC ATGCCTGCAA CAAGCGCACT
GGGGGGAAGA GGAAGGAGAT CCTGAGTGCC CTCTACTCAC CCATGGACAT CCAGGTGCTG
AGCCAGGAGC GGCAGCCTTT CTTCCACACT CGCTGTGAGG AGGACAATGG CGGCTGCTCC
CACCTGTGCC TGCTGTCCCC AAGCGAGCCT TTCTACACAT GCGCCTGCCC CACGGGTGTG
CAGCTGCAGG ACAACGGCAG GACGTGTAAG GCAGGAGCCG AGGAGGTGCT GCTGCTGGCC
CGGCGGACGG ACCTACGGAG GATCTCGCTG GACACGCCGG ACTTCACCGA CATCGTGCTG
CAGGTGGACG ACATCCGGCA CGCCATTGCC ATCGACTACG ACCCGCTAGA GGGCTATGTC
TACTGGACAG ATGACGAGGT GCGGGCCATC CGCAGGGCGT ACCTGGACGG GTCTGGGGCG
CAGACGCTGG TCAACACCGA GATCAACGAC CCCGATGGCA TCGCGGTCGA CTGGGTGGCC
CGAAACCTCT ACTGGACCGA CACGGGCACG GACCGCATCG AGGTGACGCG CCTCAACGGC
```

FIG. 25B

ZMAXGI_3AS

```
ACCTCCCGCA AGATCCTGGT GTCGGAGGAC CTGGACGAGC CCCGAGCCAT CGCACTGCAC
CCCGTGATGG GCCTCATGTA CTGGACAGAC TGGGGAGAGA ACCCTAAAAT CGAGTGTGCC
AACTTGGATG GGCAGGAGCG GCGTGTGCTG GTCAATGCCT CCCTCGGGTG GCCCAACGGC
CTGGCCCTGG ACCTGCAGGA GGGGAAGCTC TACTGGGGAG ACGCCAAGAC AGACAAGATC
GAGGTGATCA ATGTTGATGG GACGAAGAGG CGGACCCTCC TGGAGGACAA GCTCCCGCAC
ATTTTCGGGT TCACGCTGCT GGGGGACTTC ATCTACTGGA CTGACTGGCA GCGCCGCAGC
ATCGAGCGGG TGCACAAGGT CAAGGCCAGC CGGGACGTCA TCATTGACCA GCTGCCCGAC
CTGATGGGGC TCAAAGCTGT GAATGTGGCC AAGGTCGTCG GAACCAACCC GTGTGCGGAC
AGGAACGGGG GGTGCAGCCA CCTGTGCTTC TTCACACCCC ACGCAACCCG GTGTGGCTGC
CCCATCGGCC TGGAGCTGCT GAGTGACATG AAGACCTGCA TCGTGCCTGA GGCCTTCTTG
GTCTTCACCA GCAGAGCCGC CATCCACAGG ATCTCCCTCG AGACCAATAA CAACGACGTG
GCCATCCCGC TCACGGGCGT CAAGGAGGCC TCAGCCCTGG ACTTTGATGT GTCCAACAAC
CACATCTACT GGACAGACGT CAGCCTGAAG ACCATCAGCC GCGCCTTCAT GAACGGGAGC
TCGGTGGAGC ACGTGGTGGA GTTTGGCCTT GACTACCCCG AGGGCATGGC CGTTGACTGG
ATGGGCAAGA ACCTCTACTG GGCCGACACT GGGACCAACA GAATCGAAGT GGCGCGGCTG
GACGGGCAGT TCCGGCAAGT CCTCGTGTGG AGGGACTTGG ACAACCCGAG GTCGCTGGCC
CTGGATCCCA CCAAGGGCTA CATCTACTGG ACCGAGTGGG GCGGCAAGCC GAGGATCGTG
CGGGCCTTCA TGGACGGGAC CAACTGCATG ACGCTGGTGG ACAAGGTGGG CCGGGCCAAC
GACCTCACCA TTGACTACGC TGACCAGCGC CTCTACTGGA CCGACCTGGA CACCAACATG
ATCGAGTCGT CCAACATGCT GGGTCAGGAG CGGGTCGTGA TTGCCGACGA TCTCCCGCAC
CCGTTCGGTC TGACGCAGTA CAGCGATTAT ATCTACTGGA CAGACTGGAA TCTGCACAGC
ATTGAGCGGG CCGACAAGAC TAGCGGCCGG AACCGCACCC TCATCCAGGG CCACCTGGAC
TTCGTGATGG ACATCCTGGT GTTCCACTCC TCCCGCCAGG ATGGCCTCAA TGACTGTATG
```

FIG. 25C

ZMAXGI_3AS

```
CACAACAACG GGCAGTGTGG GCAGCTGTGC CTTGCCATCC CCGGCGGCCA CCGCTGCGGC
TGCGCCTCAC ACTACACCCT GGACCCCAGC AGCCGCAACT GCAGCCCGCC CACCACCTTC
TTGCTGTTCA GCCAGAAATC TGCCATCAGT CGGATGATCC CGGACGACCA GCACAGCCCG
GATCTCATCC TGCCCCTGCA TGGACTGAGG AACGTCAAAG CCATCGACTA TGACCCACTG
GACAAGTTCA TCTACTGGGT GGATGGGCGC CAGAACATCA AGCGAGCCAA GGACGACGGG
ACCCAGCCCT TTGTTTTGAC CTCTCTGAGC CAAGGCCAAA ACCCAGACAG GCAGCCCCAC
GACCTCAGCA TCGACATCTA CAGCCGGACA CTGTTCTGGA CGTGCGAGGC CACCAATACC
ATCAACGTCC ACAGGCTGAG CGGGGAAGCC ATGGGGGTGG TGCTGCGTGG GGACCGCGAC
AAGCCCAGGG CCATCGTCGT CAACGCGGAG CGAGGGTACC TGTACTTCAC CAACATGCAG
GACCGGGCAG CCAAGATCGA ACGCGCAGCC CTGGACGGCA CCGAGCGCGA GGTCCTCTTC
ACCACCGGCC TCATCCGCCC TGTGGCCCTG GTGGTAGACA ACACACTGGG CAAGCTGTTC
TGGGTGGACG CGGACCTGAA GCGCATTGAG AGCTGTGACC TGTCAGGGGC CAACCGCCTG
ACCCTGGAGG ACGCCAACAT CGTGCAGCCT CTGGGCCTGA CCATCCTTGG CAAGCATCTC
TACTGGATCG ACCGCCAGCA GCAGATGATC GAGCGTGTGG AGAAGACCAC CGGGGACAAG
CGGACTCGCA TCCAGGGCCG TGTCGCCCAC CTCACTGGCA TCCATGCAGT GGAGGAAGTC
AGCCTGGAGG AGTTCTCAGC CCACCCATGT GCCCGTGACA ATGGTGGCTG CTCCCACATC
TGTATTGCCA AGGGTGATGG GACACCACGG TGCTCATGCC CAGTCCACCT CGTGCTCCTG
CAGAACCTGC TGACCTGTGG AGAGCCGCCC ACCTGCTCCC CGGACCAGTT TGCATGTGCC
ACAGGGGAGA TCGACTGTAT CCCCGGGGCC TGGCGCTGTG ACGGCTTTCC CGAGTGCGAT
GACCAGAGCG ACGAGGAGGG CTGCCCCGTG TGCTCCGCCG CCAGTTCCCC TGCGCGCGG
GGTCAGTGTGT GGACCTGCGC CTGCGCTGCG ACGGCGAGGC AGACTGTCAG GACCGCTCA
GACGAGGCGGA CTGTGACGCC ATCTGCCTGC CCAACCAGTT CCGGTGTGCG AGCGGCCAG
TGTGTCCTCAT CAAACAGCAG TGCGACTCCT TCCCCGACTG TATCGACGGC TCCGACGAG
CTCATGTGTGA AATCACCAAG CCGCCCTCAG ACGACAGCCC GGCCCACAGC AGTGCCATC
```

FIG. 25D

ZMAXGI_3AS

```
GGGCCCGTCA TTGGCATCAT CCTCTCTCTC TTCGTCATGG GTGGTGTCTA TTTTGTGTGC
CAGCGCGTGG TGTGCCAGCG CTATGCGGGG GCCAACGGGC CCTTCCCGCA CGAGTATGTC
AGCGGGACCC CGCACGTGCC CCTCAATTTC ATAGCCCCGG GCGGTTCCCA GCATGGCCCC
TTCACAGGCA TCGCATGCGG AAAGTCCATG ATGAGCTCCG TGAGCCTGAT GGGGGGCCGG
GGCGGGGTGC CCCTCTACGA CCGGAACCAC GTCACAGGGG CCTCGTCCAG CAGCTCGTCC
AGCACGAAGG CCACGCTGTA CCCGCCGATC CTGAACCCGC CGCCCTCCCC GGCCACGGAC
CCCTCCCTGT ACAACATGGA CATGTTCTAC TCTTCAAACA TTCCGGCCAC TGCGAGACCG
TACAGGCCCT ACATCATTCG AGGAATGGCG CCCCGACGA CGCCCTGCAG CACCGACGTG
TGTGACAGCG ACTACAGCGC CAGCCGCTGG AAGGCCAGCA AGTACTACCT GGATTTGAAC
TCGGACTCAG ACCCCTATCC ACCCCCACCC ACGCCCACA GCCAGTACCT GTCGGCGGAG
GACAGCTGCC CGCCCTCGCC CGCCACCGAG AGGAGCTACT TCCATCTCTT CCCGCCCCCT
CCGTCCCCCT GCACGGACTC ATCCTGACCT CGGCCGGGCC ACTCTGGCTT CTCTGTGCCC
CTGTAAATAG TTTTAAATAT GAACAAAGAA AAAATATAT TTTATGATTT AAAAAATAAA
TATAATTGGG ATTTTAAAAA CATGAGAAAT GTGAACTGTG ATGGGGTGGG CAGGGCTGGG
AGAACTTTGT ACAGTGGAGA AATATTTATA AACTTAATTT TGTAAAACAG AAAAAAAAAA
AAAAAAAAAA AAAAAAAAAA AAAAAAAAAA AAAAAAAAAA AAAAAAAAAA AAAAAAAAAA
AAAAAAAAAA AAAAAAAAAA AAAAAAAAAA AAAAAAAAAA AAAAAAAAAA GCGGCCGC
```

FIG. 26A
Alignment of Human and Mouse Zmax1 (LRP5)
Amino-Acid Sequences.
Top= Human, Bottom = Mouse

```
  1 MEA....APPGPPWPLLLLLLLLLALCGCPAPAAASPLLLFANRRDVRLV  46
    ||.    |||.|| |||||:    |:::.||||||||||||||||||||
  1 METAPTRAPPPPPPPLLLLV.....LYCSLVPAAASPLLLFANRRDVRLV  45

47 DAGGVKLESTIVVSGLEDAAAVDFQFSKGAVYWTDVSEEAIKQTYLNQTG  96
    ||||||||||||.||||||||||||||||||||||||||||||||||||
 46 DAGGVKLESTIVASGLEDAAAVDFQFSKGAVYWTDVSEEAIKQTYLNQTG  95

97 AAVQNVVISGLVSPDGLACDWVGKKLYWTDSETNRIEVANLNGTSRKVLF 146
    ||.||:|||||||||||||||||||||||||||||||||||||||||||
 96 AAAQNIVISGLVSPDGLACDWVGKKLYWTDSETNRIEVANLNGTSRKVLF 145

147 WQDLDQPRAIALDPAHGYMYWTDWGETPRIERAGMDGSTRKIIVDSDIYW 196
    |||||||||||||||||||||||||.|||||||||||||||||||||||
146 WQDLDQPRAIALDPAHGYMYWTDWGEAPRIERAGMDGSTRKIIVDSDIYW 195

197 PNGLTIDLEEQKLYWADAKLSFIHRANLDGSFRQKVVEGSLTHPFALTLS 246
    |||||||||||||||||||||||||||||||||||||||||||||||||
196 PNGLTIDLEEQKLYWADAKLSFIHRANLDGSFRQKVVEGSLTHPFALTLS 245

247 GDTLYWTDWQTRSIHACNKRTGGKRKEILSALYSPMDIQVLSQERQPFFH 296
    |||||||||||||||||||:||:.|||||||||||||||||||||||.||
246 GDTLYWTDWQTRSIHACNKWTGEQRKEILSALYSPMDIQVLSQERQPPFH 295

297 TRCEEDNGGCSHLCLLSPSEPFYTCACPTGVQLQDNGRTCKAGAEEVLLL 346
    |.|||||||||||||||.||||.||||||||||||||:|||.|||||||
296 TPCEEDNGGCSHLCLLSPREPFYSCACPTGVQLQDNGKTCKTGAEEVLLL 345

347 ARRTDLRRISLDTPDFTDIVLQVDDIRHAIAIDYDPLEGYVYWTDDEVRA 396
    |||||||||||||||||||||||:|||||||||||||||||||||||||
346 ARRTDLRRISLDTPDFTDIVLQVGDIRHAIAIDYDPLEGYVYWTDDEVRA 395

397 IRRAYLDGSGAQTLVNTEINDPDGIAVDWVARNLYWTDTGTDRIEVTRLN 446
    |||||||||||||||||||||||||||||||||||||||||||||||||
396 IRRAYLDGSGAQTLVNTEINDPDGIAVDWVARNLYWTDTGTDRIEVTRLN 445

447 GTSRKILVSEDLDEPRAIALHPVMGLMYWTDWGENPKIECANLDGQERRV 496
    ||||||||||||||||.||||||||||||||||||||||||||:|:|
446 GTSRKILVSEDLDEPRAIVLHPVMGLMYWTDWGENPKIECANLDGRDRHV 495

497 LVNASLGWPNGLALDLQEGKLYWGDAKTDKIEVINVDGTKRRTLLEDKLP 546
    ||:.||||||||||||||||||||||||||||||:||||||:||||||||
496 LVNTSLGWPNGLALDLQEGKLYWGDAKTDKIEVINIDGTKRKTLLEDKLP 545

547 HIFGFTLLGDFIYWTDWQRRSIERVHKVKASRDVIIDQLPDLMGLKAVNV 596
    |||||||||||||||||||||||||||||||||||||||||||||||||
546 HIFGFTLLGDFIYWTDWQRRSIERVHKVKASRDVIIDQLPDLMGLKAVNV 595

597 AKVVGTNPCADRNGGCSHLCFFTPHATRCGCPIGLELLSDMKTCIVPEAF 646
    |||||||||| |||||||||||||:||:||||||||||||||||:||||
596 AKVVGTNPCADGNGGCSHLCFFTPRATKCGCPIGLELLSDMKTCIIPEAF 645

647 LVFTSRAAIHRISLETNNNDVAIPLTGVKEASALDFDVSNNHIYWTDVSL 696
    ||||||.|||||||||||||||||||||||||||||||||||||||||
646 LVFTSRATIHRISLETNNNDVAIPLTGVKEASALDFDVSNNHIYWTDVSL 695
```

FIG. 26B
Alignment of Human and Mouse Zmax1 (LRP5)
Amino-Acid Sequences.

```
 697 KTISRAFMNGSSVEHVVEFGLDYPEGMAVDWMGKNLYWADTGTNRIEVAR  746
     ||||||||||||||||:|||||||||||||||||||||||||||||||||
 696 KTISRAFMNGSSVEHVIEFGLDYPEGMAVDWMGKNLYWADTGTNRIEVAR  745

747 LDGQFRQVLVWRDLDNPRSLALDPTKGYIYWTEWGGKPRIVRAFMDGTNC  796
     ||||||||||||||||||||||||||||||||||||||||||||||||||
 746 LDGQFRQVLVWRDLDNPRSLALDPTKGYIYWTEWGGKPRIVRAFMDGTNC  795

797 MTLVDKVGRANDLTIDYADQRLYWTDLDTNMIESSNMLGQERVVIADDLP  846
     |||||||||||||||||||||||||||||||||||||||||||:||||||
 796 MTLVDKVGRANDLTIDYADQRLYWTDLDTNMIESSNMLGQERMVIADDLP  845

847 HPFGLTQYSDYIYWTDWNLHSIERADKTSGRNRTLIQGHLDFVMDILVFH  896
     .|||||||||||||||||||||||||||||||||||||||||||||||||
 846 YPFGLTQYSDYIYWTDWNLHSIERADKTSGRNRTLIQGHLDFVMDILVFH  895

897 SSRQDGLNDCMHNNGQCGQLCLAIPGGHRCGCASHYTLDPSSRNCSPPTT  946
     ||||||||||:|.|||||||||||||||||||||||||||||||||||.|
 896 SSRQDGLNDCVHSNGQCGQLCLAIPGGHRCGCASHYTLDPSSRNCSPPST  945

947 FLLFSQKSAISRMIPDDQHSPDLILPLHGLRNVKAIDYDPLDKFIYWVDG  996
     |||||||.|||||||||||:||||:||||||||||:||||||||||||||
 946 FLLFSQKFAISRMIPDDQLSPDLVLPLHGLRNVKAINYDPLDKFIYWVDG  995

997 RQNIKRAKDDGTQPFVLTSLSQGQNPDRQPHDLSIDIYSRTLFWTCEATN 1046
     ||||||||||||||:|||.||:...|||||||||||||||||||||||||
 996 RQNIKRAKDDGTQPSMLTSPSQSLSPDRQPHDLSIDIYSRTLFWTCEATN 1045

1047 TINVHRLSGEAMGVVLRGDRDKPRAIVVNAERGYLYFTNMQDRAAKIERA 1096
     |||||||.|:.|||||||||||||||.|||||||:||||||||:||||||
1046 TINVHRLDGDAMGVVLRGDRDKPRAIAVNAERGYMYFTNMQDHAAKIERA 1095

1097 ALDGTEREVLFTTGLIRPVALVVDNTLGKLFWVDADLKRIESCDLSGANR 1146
     .|||||||||||||||||||||||||.|||||||||||||||||||||||
1096 SLDGTEREVLFTTGLIRPVALVVDNALGKLFWVDADLKRIESCDLSGANR 1145

1147 LTLEDANIVQPLGLTILGKHLYWIDRQQQMIERVEKTTGDKRTRIQGRVA 1196
     ||||||||||:|||:||:|||||||||||||||||||||||||:||||.
1146 LTLEDANIVQPVGLTVLGRHLYWIDRQQQMIERVEKTTGDKRTRVQGRVT 1195

1197 HLTGIHAVEEVSLEEFSAHPCARDNGGCSHICIAKGDGTPRCSCPVHLVL 1246
     ||||||||||||||||||||||||||||||||||||||||||||||||||
1196 HLTGIHAVEEVSLEEFSAHPCARDNGGCSHICIAKGDGTPRCSCPVHLVL 1245

1247 LQNLLTCGEPPTCSPDQFACATGEIDCIPGAWRCDGFPECDDQSDEEGCP 1296
     |||||||||||||||||||||.|||||||||||||||||||.||||||||
1246 LQNLLTCGEPPTCSPDQFACTTGEIDCIPGAWRCDGFPECADQSDEEGCP 1295

1297 VCSAAQFPCARGQCVDLRLRCDGEADCQDRSDEADCDAICLPNQFRCASG 1346
     ||||.|||||||||||||||||||||||||||||:|||.|||||||||.|
1296 VCSASQFPCARGQCVDLRLRCDGEADCQDRSDEANCDAVCLPNQFRCTSG 1345

1347 QCVLIKQQCDSFPDCIDGSDELMCEITKPPSDDSPAHSSAIGPVIGIILS 1396
     |||||||||||||||.||||||||||.||||||.||||||||||||||||
1346 QCVLIKQQCDSFPDCADGSDELMCEINKPPSDDIPAHSSAIGPVIGIILS 1395

1397 LFVMGGVYFVCQRVVCQRYAGANGPFPHEYVSGTPHVPLNFIAPGGSQHG 1446
     |||||||||||||:||||.||.||||||||:|.|||||||||||||||||
1396 LFVMGGVYFVCQRVMCQRYTGASGPFPHEYVGGAPHVPLNFIAPGGSQHG 1445
```

FIG. 26C
Alignment of Human and Mouse Zmax1 (LRP5)
Amino-Acid Sequences.

```
1447 PFTGIACGKSMMSSVSLMGGRGGVPLYDRNHVTGASSSSSSSSTKATLYPP 1496
     ||.||:|:||:|||:||||:||||||||||||||||||||||||||||||
1446 PFPGIPCSKSVMSSMSLVGGRGSVPLYDRNHVTGASSSSSSSSTKATLYPP 1495

1497 ILNPPPSPATDPSLYNMDMFYSSNIPATARPYRPYIIRGMAPPTTPCSTD 1546
     ||||||||||||||||:|:|||.|||||||||||||:||||||||||||
1496 ILNPPPSPATDPSLYNVDVFYSSGIPATARPYRPYVIRGMAPPTTPCSTD 1545

1547 VCDSDYSASRWKASKYYLDLNSDSDPYPPPPTPHSQYLSAEDSCPPSPAT 1596
     |||||| ||||.||||||||||||||||||||||||||||||||||||:|
1546 VCDSDYSISRWKSSKYYLDLNSDSDPYPPPPTPHSQYLSAEDSCPPSPGT 1595

1597 ERSYFHLFPPPPSPCTDSS 1615
     |||| ||||||||||||||
1596 ERSYCHLFPPPPSPCTDSS 1614
```

FIG. 27A
Alignment of Human LRP5 and LRP6

Top = LRP5, Bottom = LRP6

<u>Underlined</u> = region marked for antibody production

Percent Similarity: 83.542   Percent Identity: 70.901

```
  1 MEAAPPGPPWPLLLLLLLLLALCGCPAPAAASPLLLFANRRDVRLVDAGG  50
    : :|  ||| |:       |.||||:|||||:||||..
  1 ..........MGAVLRSLLA.CSFCVLLRAAPLLLYANRRDLRLVDATN  38

51 VKLESTIVVSGLEDAAAVDFQFSKGAVYWTDVSEEAIKQTYLNQTGAAVQ 100
    .|  :.||||:||||||||||  ||.|  :||.||||||||.|  :|.|:  .||
 39 GKENATIVVGGLEDAAAVDFVFSHGLIYWSDVSEEAIKRTEFNKTE.SVQ  87

101 NVVISGLVSPDGLACDWVGKKLYWTDSETNRIEVANLNGTSRKVLFWQDL 150
    |||:|||:|||||||||:|.|||||||||||||||.||:|. ||||||:|
 88 NVVVSGLLSPDGLACDWLGEKLYWTDSETNRIEVSNLDGSLRKVLFWQEL 137

151 DQPRAIALDPAHGYMYWTDWGETPRIERAGMDGSTRKIIVDSDIYWPNGL 200
    |||||||||. |:|||||||.|:||||||||.| ||::|:|||||||
138 DQPRAIALDPSSGFMYWTDWGEVPKIERAGMDGSSRFIIINSEIYWPNGL 187

201 TIDLEEQKLYWADAKLSFIHRANLDGSFRQKVVEGSLTHPFALTLSGDTL 250
    |:|.||||||||||||.||:..||||  || ||.||.|||||||||  :|.|
188 TLDYEEQKLYWADAKLNFIHKSNLDGTNRQAVVKGSLPHPFALTLFEDIL 237

251 YWTDWQTRSIHACNKRTGGKRKEILSALYSPMDIQVLSQERQPFFHTRCE 300
    ||||  |:||  |||| ||:  :|| |.::|||||..:|| |||    .|:
238 YWTDWSTHSILACNKYTGEGLREIHSDIFSPMDIHAFSQQRQPNATNPCG 287

301 EDNGGCSHLCLLSPSEPFYTCACPTGVQLQDNGRTCKAGAEEVLLLARRT 350
    |||||||||:||  .||| ||||||.| :||:|||.||.|:|||||||
288 IDNGGCSHLCLMSPVKPFYQCACPTGVKLLENGKTCKDGATELLLLARRT 337

351 DLRRISLDTPDFTDIVLQVDDIRHAIAIDYDPLEGYVYWTDDEVRAIRRA 400
    |||||||||||||||||::|||||||||||||:|||:|||||||||||.
338 DLRRISLDTPDFTDIVLQLEDIRHAIAIDYDPVEGYIYWTDDEVRAIRRS 387

401 YLDGSGAQTLVNTEINDPDGIAVDWVARNLYWTDTGTDRIEVTRLNGTSR 450
    ::|||.| :|...|..|||||||||||||||||||||||||||||| |
388 FIDGSGSQFVVTAQIAHPDGIAVDWVARNLYWTDTGTDRIEVTRLNGTMR 437

451 KILVSEDLDEPRAIALHPVMGLMYWTDWGENPKIECANLDGQERRVLVNA 500
    |||:|||:||||||:.|:: .|||||||||:|||||||  |.|||  :| ||||.
438 KILISEDLEEPRAIVLDPMVGYMYWTDWGEIPKIERAALDGSDRVVLVNT 487

501 SLGWPNGLALDLQEGKLYWGDAKTDKIEVINVDGTKRRTLLEDKLPHIFG 550
    ||||||||||||:|||:||||||||||||:|.|||.||||:|||||||
488 SLGWPNGLALDYDEGKIYWGDAKTDKIEVMNTDGTGRRVLVEDKIPHIFG 537

551 FTLLGDFIYWTDWQRRSIERVHKVKASRDVIIDQLPDLMGLKAVNVAKVV 600
    |||||||:||||||||||||||| .|.|:|||||||||||||:.|| |:
538 FTLLGDYVYWTDWQRRSIERVHKRSAEREVIIDQLPDLMGLKATNVHRVI 587

601 GTNPCADRNGGCSHLCFFTPHATRCGCPIGLELLSDMKTCIVPEAFLVFT 650
    |.||| ||||||||||  |:: :|:.|||||||||||||||||||  :
588 GSNPCAEENGGCSHLCLYRPQGLRCACPIGFELISDMKTCIVPEAFLLFS 637
```

FIG. 27B
Alignment of Human LRP5 and LRP6

```
 651 SRAAIHRISLETNNNDVAIPLTGVKEASALDFDVSNNHIYWTDVSLKTIS  700
     .||.|:||||||||:||||||||||||||..:|:||||:||||||
 638 RRADIRRISLETNNNNVAIPLTGVKEASALDFDVTDNRIYWTDISLKTIS  687

701 RAFMNGSSVEHVVEFGLDYPEGMAVDWMGKNLYWADTGTNRIEVARLDGQ  750
     |||||||.:|||||||||||||||||:|||||||||||||..:|||
 688 RAFMNGSALEHVVEFGLDYPEGMAVDWLGKNLYWADTGTNRIEVSKLDGQ  737

751 FRQVLVWRDLDNPRSLALDPTKGYIYWTEWGGKPRIVRAFMDGTNCMTLV  800
     ||||||||:|||.||.|||||..|::|||||||:|.||.|||.:.|||
 738 HRQVLVWKDLDSPRALALDPAEGFMYWTEWGGKPKIDRAAMDGSERTTLV  787

801 DKVGRANDLTIDYADQRLYWTDLDTNMIESSNMLGQERVVIADDLPHPFG  850
     ..||||||:||||||..|||||||||:|||||||||.:|.||||||||||
 788 PNVGRANGLTIDYAKRRLYWTDLDTNLIESSNMLGLNREVIADDLPHPFG  837

851 LTQYSDYIYWTDWNLHSIERADKTSGRNRTLIQGHLDFVMDILVFHSSRQ  900
     ||||.||||||||.:::||||:||||.|||:|||||:|||||||||||||
 838 LTQYQDYIYWTDWSRRSIERANKTSGQNRTIIQGHLDYVMDILVFHSSRQ  887

901 DGLNDCMHNNGQCGQLCLAIP.GGHRCGCASHYTLDPSSRNCSPPTTFLL  949
     .|:|:|||:|||:||.|:||||||.|.|:|:|||:||||||
 888 SGWNECASSNGHCSHLCLAVPVGGFVCGCPAHYSLNADNRTCSAPTTFLL  937

950 FSQKSAISRMIPDDQHSPDLILPLHGLRNVKAIDYDPLDKFIYWVDGRQN  999
     |||||||.||:|:.|:|||:|||:||||.|:|||||||||:|||:||||
 938 FSQKSAINRMVIDEQQSPDIILPIHSLRNVRAIDYDPLDKQLYWIDSRQN  987

1000 .IKRAKDDGTQPF.VLTSLSQGQNPDRQPHDLSIDIYSRTLFWTCEATNT 1047
     .|::|.:||.|.|.|:.|||||.||||||||::||||||.
 988 MIRKAQEDGSQGFTVVVSSVPSQNLEIQPYDLSIDIYSRYIYWTCEATNV 1037

1048 INVHRLSGEAMGVVLRGDRDKPRAIVVNAERGYLYFTNMQDRAAKIERAA 1097
     |||.||.|..:||||:|:.|:||||||||:|||:||:|:||||
1038 INVTRLDGRSVGVVLKGEQDRPRAIVVNPEKGYMYFTNLQERSPKIERAA 1087

1098 LDGTEREVLFTTGLIRPVALVVDNTLGKLFWVDADLKRIESCDLSGANRL 1147
     ||||||||||.||.:|:||.:|.:|.||||||.|.||:||||:|||||:
1088 LDGTEREVLFFSGLSKPIALALDSRLGKLFWADSDLRRIESSDLSGANRI 1137

1148 TLEDANIVQPLGLTILGKHLYWIDRQQQMIERVEKTTGDKRTRIQGRVAH 1197
     .|||.||:||:|||:|:..|||||:||||||:|||||||:::.|.|:::.|:|:
1138 VLEDSNILQPVGLTVFENWLYWIDKQQQMIEKIDMTGREGRTKVQARIAQ 1187

1198 LTGIHAVEEVSLEEFSAHPCARDNGGCSHICIAKGDGTPRCSCPVHLVLL 1247
     |.:||||.|::|:|.|||||.||||||||:|.||||.|||||:|||||
1188 LSDIHAVKELNLQEYRQHPCAQDNGGCSHICLVKGDGTTRCSCPMHLVLL 1237

1248 QNLLTCGEPPTCSPDQFACATGEIDCIPGAWRCDGFPECDDQSDEEGCPV 1297
     |:.|.|||||||||.||.|.|||||||.|||||||.|||:||.||||
1238 QDELSCGEPPTCSPQQFTCFTGEIDCIPVAWRCDGFTECEDHSDELNCPV 1287

1298 CSAAQFPCARGQCVDLRLRCDGEADCQDRSDEADCDAICLPNQFRCASGQ 1347
     ||..||.||.|||:||.|||||.||:|||:||:::|||||||.||
1288 CSESQFQCASGQCIDGALRCNGDANCQDKSDEKNCEVLCLIDQFRCANGQ 1337

1348 CVLIKQQCDSFPDCIDGSDELMCEITKPPSDDSPAHSSAIGPVIGIILSL 1397
     |:..||.||.||.|||||.|.|.|...|:|||||::
1338 CIGKHKKCDHNVDCSDKSDELDCYPTEEP...APQATNTVGSVIGVIVTI 1384
```

FIG. 27C
Alignment of Human LRP5 and LRP6

```
1398 FVMGGVYFVCQRVVCQRYAGANGPFPHEYVS.GTPHVPLNFIAPGGSQHG 1446
     || |.|||:|||::|.|  |.:::::||  |.: |||.::...:|  |
1385 FVSGTVYFICQRMLCPRMKGDGETMTNDYVVHGPASVPLGYVPHPSSLSG 1434

1447 PFTGIACGKSMMSSVSLMGGRGGVPLYDRNHVTGASSSSSSSSTKATLYPP 1496
     .:.|:. ||||:||:|:|||.:|.|  |||.||||||||||||||:|.:|:
1435 SLPGMSRGKSMISSLSIMGGSSGPP.YDRAHVTGASSSSSSSTKGTYFPA 1483

1497 ILNPPPSPATDPSLYNMDMFYSSNIPATAR...PYRPYIIRGMAPPTTPCS 1544
     ||||||||||:.| |.|:: |||| |.| |   .|||  .|  :||||||
1484 ILNPPPSPATERSHYTMEFGYSSNSPSTHRSYSYRPYSYRHFAPPTTPCS 1533

1545 TDVCDSDYSASRWKAS.....KYYLDLNSDSDPYPPPPTPHSQYLSAE.. 1587
     ||||||||.:||:..|     |  ||| ||:| ||||||:||||||
1534 TDVCDSDYAPSRRMTSVATAKGYTSDLNYDSEPVPPPPTPRSQYLSAEEN 1583

1588 .DSCPPSPATERSY.FHLFPPPPSPCTDSS 1615
     :|||||| |||||  ||:|||||||||||
1584 YESCPPSPYTERSYSHHLYPPPPSPCTDSS 1613
```

Model of Wnt signaling

| Gene | Genbank Accession # | Protein Accession # |
|---|---|---|
| granulin | M75161 | AAA58617 |
| similar to cys/His rich protein | BC004544 | AAH04544 |
| IGF-BINDING PROTEIN 6 | M69054 | AAA88070 |
| latent TGFb binding protein 4 | AF051344 | AAC39879 |
| NOTCH 2 | AF315356 | AAG37073 |
| fibulin 1 | X53743 | CAA37772 |
| MDC15 (ADAM15) | U46005 | AAC51112 |
| DKFZp761G02121(notch1 Ca++ binding like) | AL137311 | CAB70690 |
| chordin | AF076612 | AAC69835 |
| fibronectin 1 | U42594 | AAD00019 |
| MG50(melanoma associated antigen) | AF200348 | AAF06354 |
| unknown (notch 4-like) | AX068260 | CAC27245 |
| Slit 1 | AB017167 | BAA35184 |
| tomoregulin (agarin repeat homology) | AB004064 | BAA90820 |
| sprouty 1 | AF041037 | AAC39566 |
| sprouty 2 | AF039843 | AAC04258 |
| NOV1 | X96584 | CAA65403 |
| agrin | AF016903 | AAC39776 |
| fibrillin 1 | L13923 | AAB02036 |
| thrombospondin1 | X04665 | CAA28370 |
| ADAM19 | AF134707 | AAF22162 |
| Nafl alpha | AJ011895 | CAA09855 |
| laminin alpha 5 | Z95636 | CAB09137 |
| CRIM1 | AF167706 | AAF34409 |
| nidogen | M30269 | AAA59932 |
| fibulin-2 | X82494 | CAA57876 |
| thrombospondin 2 | L12350 | AAA03703 |
| KIAA1323 | AB037744 | BAA92561 |
| fibrillin-2 | U03272 | AAA18950 |
| MEGF9 | AB011542 | BAA32470 |
| integrin beta 1 | X07979 | CAA30790 |
| matrilin-2 precursor | U69263 | AAC51260 |
| tenascin | X56160 | A32160 |

FIG. 31

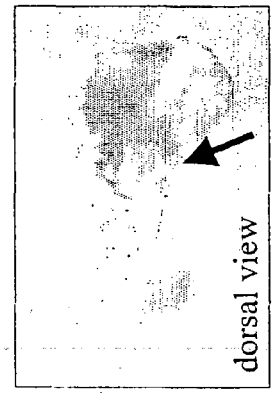
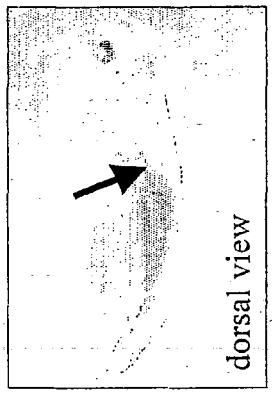
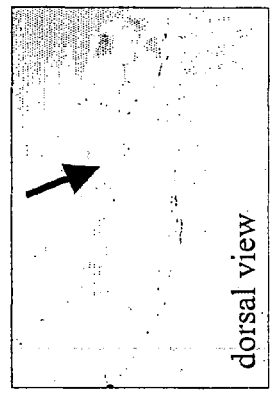
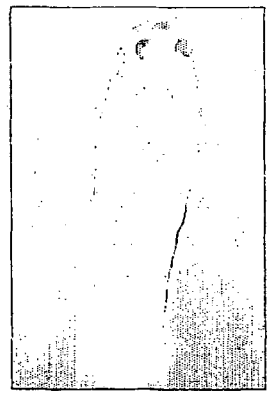
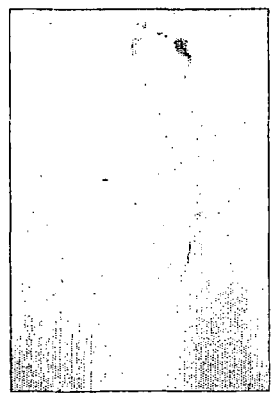
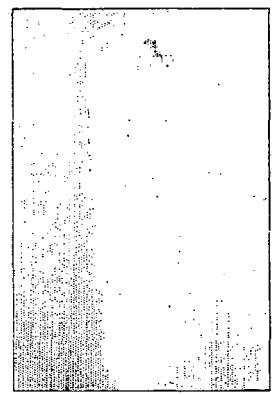
FIG. 35 Both Zmax and HBM1, in the presence of Wnt5a, induce secondary axis formation in Xenopus (photos at 48 hrs post-injection)

zmaxLBD
1,4
screen X
peptide
library

| Peptide Number | Peptide Sequence | No. of Hits |
|---|---|---|
| 9 | VVLCSRCGRLWRWSCG | 1 |
| 12 | EVRQVTCIRCRRGFLL | 1 |
| 13 | GGGGMWEAWSCYACG | 1 |
| 14 | GWRWCGRCGALWWRRV | 3 |

FIG. 38

Listed are the pcDNA3.1 construct names followed by the DNA sequence

OST258 (control for OST 259-OST262 and OST264,OST265)
AAGCTTGCCACCATGGAGACAGACACACTCCTGCTATGGGTACTGCTGCTCTG
GGTTCCAGGTTCCACTGGTGACGGATCC OST259
AAGCTTGCCACCATGGAGACAGACACACTCCTGCTATGGGTACTGCTGCTCTG
GGTTCCAGGTTCCACTGGTGACGGATCCATGAGCGATAAAATTATTCACCTGA
CTGACGACAGTTTTGACACGGATGTACTCAAAGCGGACGGGGCGATCCTCGTC
GATTTCTGGGCAGAGTGGTGCGGTCCGAATTCCGTGGTTCTGTGTTCGCGTTG
TGGGCGTTTGTGGCGGTGGTCGTGTGGGACTAGTGGTCCGTGCAAAATGATCG
CCCCGATTCTGGATGAAATCGCTGACGAATATCAGGGCAAACTGACCGTTGCA
AAACTGAACATCGATCAAACCCTGGCACTGCGCCGAAATATGGCATCCGTGG
TATCCCGACTCTGCTGCTGTTCAAAAACGGTGAAGTGGCGGCAACCAAAGTGG
GTGCACTGTCTAAAGGTCAGTTGAAAGAGTTCCTCGACGCTAACCTGGCGTAA
GCGGCCGC OST260
AAGCTTGCCACCATGGAGACAGACACACTCCTGCTATGGGTACTGCTGCTCTG
GGTTCCAGGTTCCACTGGTGACGGATCCATGAGCGATAAAATTATTCACCTGA
CTGACGACAGTTTTGACACGGATGTACTCAAAGCGGACGGGGCGATCCTCGTC
GATTTCTGGGCAGAGTGGTGCGGTCCGAATTCCGGGTGGCGGTGGTGTGGTCG
GTGTGGGGCTTTGTGGTGGCGGCGTGTTACTAGTGGTCCGTGCAAAATGATCG
CCCCGATTCTGGATGAAATCGCTGACGAATATCAGGGCAAACTGACCGTTGCA
AAACTGAACATCGATCAAACCCTGGCACTGCGCCGAAATATGGCATCCGTGG
TATCCCGACTCTGCTGCTGTTCAAAAACGGTGAAGTGGCGGCAACCAAAGTGG
GTGCACTGTCTAAAGGTCAGTTGAAAGAGTTCCTCGACGCTAACCTGGCGTAA
GCGGCCGC OST261
AAGCTTGCCACCATGGAGACAGACACACTCCTGCTATGGGTACTGCTGCTCTG
GGTTCCAGGTTCCACTGGTGACGGATCCATGAGCGATAAAATTATTCACCTGA
CTGACGACAGTTTTGACACGGATGTACTCAAAGCGGACGGGGCGATCCTCGTC
GATTTCTGGGCAGAGTGGTGCGGTCCGAATTCCGAGGTGCGGCAGGTTACGTG
TATTAGGTGTCGTCGGGGTTTTCTGTTGACTAGTGGTCCGTGCAAAATGATCG
CCCCGATTCTGGATGAAATCGCTGACGAATATCAGGGCAAACTGACCGTTGCA

FIG. 39A

AAACTGAACATCGATCAAAACCCTGGCACTGCGCCGAAATATGGCATCCGTGG
TATCCCGACTCTGCTGCTGTTCAAAAACGGTGAAGTGGCGGCAACCAAAGTGG
GTGCACTGTCTAAAGGTCAGTTGAAAGAGTTCCTCGACGCTAACCTGGCGTAA
GCGGCCGC

OST262
AAGCTTGCCACCATGGAGACAGACACACTCCTGCTATGGGTACTGCTGCTCTG
GGTTCCAGGTTCCACTGGTGACGGATCCATGAGCGATAAATTATTCACCTGA
CTGACGACAGTTTTGACACGGATGTACTCAAAGCGGACGGGGCGATCCTCGTC
GATTTCTGGGCAGAGTGGTGCGGTCCGAATTCCGGTGGTGGGGGATGATTTG
GGAGGCTTGGAGTTGTTATGCGTGTGGACTAGTGGTCCGTGCAAATGATCG
CCCCGATTCTGGATGAAATCGCTGACGAATATCAGGGCAAACTGACCGTTGCA
AAACTGAACATCGATCAAAACCCTGGCACTGCGCCGAAATATGGCATCCGTGG
TATCCCGACTCTGCTGCTGTTCAAAAACGGTGAAGTGGCGGCAACCAAAGTGG
GTGCACTGTCTAAAGGTCAGTTGAAAGAGTTCCTCGACGCTAACCTGGCGTAA
GCGGCCGC

OST263
AAGCTTGCCACCATGGAGACAGACACACTCCTGCTATGGGTACTGCTGCTCTG
GGTTCCAGGTTCCACTGGTGACGGATCCATGAGCGATAAATTATTCACCTGA
CTGACGACAGTTTTGACACGGATGTACTCAAAGCGGACGGGGCGATCCTCGTC
GATTTCTGGGCAGAGTGGTGCGGTCCGAATTCCTTGTGGATTGGGCCGGGTGA
TCAGGGTCTGTTTCGGCGTTTTGTTTTTACTAGTGGTCCGTGCAAATGATCG
CCCCGATTCTGGATGAAATCGCTGACGAATATCAGGGCAAACTGACCGTTGCA
AAACTGAACATCGATCAAAACCCTGGCACTGCGCCGAAATATGGCATCCGTGG
TATCCCGACTCTGCTGCTGTTCAAAAACGGTGAAGTGGCGGCAACCAAAGTGG
GTGCACTGTCTAAAGGTCAGTTGAAAGAGTTCCTCGACGCTAACCTGGCGTAA
GCGGCCGC

OST264
AAGCTTGCCACCATGGAGACAGACACACTCCTGCTATGGGTACTGCTGCTCTG
GGTTCCAGGTTCCACTGGTGACGGATCCGTGTCTTCTGATCAAAATCATTTCC
GAGGAGAAATTGAGGAAACCATCACTGAAAGCTTTGGTAATGATCATAGCACC
TTGGATGGGTATTCCAGAAGAACCACCTTGTCTTCAAAATGTATCACACCAA
AGGACAAGAAGGTTCTGTTTGTCTCCGGTCATCAGACTGTGCCTCAGGATTGT
GTTGTGCTAGACACTTCTGGTCCAAGATCTGTAAACCTGTCCTGAAAGAAGGT
CAAGTGTGTACCAAGCATAGGAGAAAGGCTCTCATGGACTAGAAATATTCCA
GCGTTGTTACTGTGGAGAAGGTCTGTCTTGCCGGATACAGAAAGATCACCATC
AAGCCAGTAATTCTTCTAGGCTTCACACTTGTCAGAGACACTAAGCGGCCGC

FIG. 39B

OST265
AAGCTTGCCACCATGGAGACAGACACACTCCTGCTATGGGTACTGCTGCTCTG
GGTTCCAGGTTCCACTGGTGACGGATCCTGCGCTAGTCCCACCCGCGGAGGGG
ACGCGGGCGTGCAAATCTGTCTCGCCTGCAGGAAGCGCCGAAAACGCTGCATG
CGTCACGCTATGTGCTGCCCCGGGAATTACTGCAAAAATGGAATATGTGTGTC
TTCTGATCAAAATCATTTCCGAGGAGAAATTGAGGAAACCATCACTGAAAGCT
TTGGTAATGATCATAGCACCTTGGATGGGTATTCCAGAAGAACCACCTTGTCT
TCAAAAATGTATCACACCAAGGACAAGAAGGTTCTGTTTGTCTCCGGTCATC
AGACTGTGCCTCAGGATTGTGTTGTGCTAGACACTTCTGGTCCAAGATCTGTA
AACCTGTCCTGAAAGAAGGTCAAGTGTGTACCAAGCATAGGAGAAAAGGCTCT
CATGGACTAGAAATATTCCAGCGTTGTTACTGTGGAGAAGGTCTGTCTTGCTA
AGCGGCCGC

OST266
AAGCTTGCCACCATGGGCGATAAAATTATTCACCTGACTGACGACAGTTTTGA
CACGGATGTACTCAAAGCGGACGGGGCGATCCTCGTCGATTTCTGGGCAGAGT
GGTGCGGTCCGAATTCCTATGCGTGGTTGTTTTCTTGTAGTAGGTGTAGGTGG
TGGTTGCCTTGGACTAGTGGTCCGTGCAAATGATCGCCCCGATTCTGGATGA
AATCGCTGACGAATATCAGGGCAAACTGACCGTTGCAAAACTGAACATCGATC
AAAACCCTGGCACTGCGCCGAAATATGGCATCCGTGGTATCCCGACTCTGCTG
CTGTTCAAAAACGGTGAAGTGGCGGCAACCAAAGTGGGTGCACTGTCTAAAGG
TCAGTTGAAAGAGTTCCTCGACGCTAACCTGGCGTAAGCGGCCGC

OST267
AAGCTTGCCACCATGGGCGATAAAATTATTCACCTGACTGACGACAGTTTTGA
CACGGATGTACTCAAAGCGGACGGGGCGATCCTCGTCGATTTCTGGGCAGAGT
GGTGCGGTCCGAATTCCATTTGTGAGGTTGTGAGGTTGTGGAGTCGGTATCCT
TGGTCTTGGGTGACTAGTGGTCCGTGCAAATGATCGCCCCGATTCTGGATGA
AATCGCTGACGAATATCAGGGCAAACTGACCGTTGCAAAACTGAACATCGATC
AAAACCCTGGCACTGCGCCGAAATATGGCATCCGTGGTATCCCGACTCTGCTG
CTGTTCAAAAACGGTGAAGTGGCGGCAACCAAAGTGGGTGCACTGTCTAAAGG
TCAGTTGAAAGAGTTCCTCGACGCTAACCTGGCGTAAGCGGCCGC

FIG. 39C

OST268
AAGCTTGCCACCATGGGCGATAAAATTATTCACCTGACTGACGACAGTTTTGA
CACGGATGTACTCAAAGCGGACGGGGCGATCCTCGTCGATTTCTGGGCAGAGT
GGTGCGGTCCGAATTCCGGTTGTACTAGTGCGGTGTGTGGTGCTTGGGCTGAG
GCGGGTAGGTTTTATTGTACTAGTGGTCCGTGCAAAATGATCGCCCCGATTCT
GGATGAAATCGCTGACGAATATCAGGGCAAACTGACCGTTGCAAAACTGAACA
TCGATCAAAACCCTGGCACTGCGCCGAAATATGGCATCCGTGGTATCCCGACT
CTGCTGCTGTTCAAAAACGGTGAAGTGGCGGCAACCAAAGTGGGTGCACTGTC
TAAAGGTCAGTTGAAAGAGTTCCTCGACGCTAACCTGGCGTAAGCGGCCGC

OST269 (irrelevant control peptide for OST266-OST268)
AAGCTTGCCACCATGGGCGATAAAATTATTCACCTGACTGACGACAGTTTTGA
CACGGATGTACTCAAAGCGGACGGGGCGATCCTCGTCGATTTCTGGGCAGAGT
GGTGCGGTCCGAATTCCTTGTGGATTGGGCCGGGTGATCAGGGTCTGTTTCGG
CGTTTTGTTTTTACTAGTGGTCCGTGCAAAATGATCGCCCCGATTCTGGATGA
AATCGCTGACGAATATCAGGGCAAACTGACCGTTGCAAAACTGAACATCGATC
AAAACCCTGGCACTGCGCCGAAATATGGCATCCGTGGTATCCCGACTCTGCTG
CTGTTCAAAAACGGTGAAGTGGCGGCAACCAAAGTGGGTGCACTGTCTAAAGG
TCAGTTGAAAGAGTTCCTCGACGCTAACCTGGCGTAAGCGGCCGC

FIG. 39D

Listed below are the amino acid sequences corresponding to the
pcDNA3.1 constructs in Appendix 1A

OST258
METDTLLLWVLLLWVPGSTGDGS

OST259
METDTLLLWVLLLWVPGSTGDGSMSDKIIHLTDDSFDTDVLKADGAILVDFWA
EWCGPNSVVLCSRCGRLWRWSCGTSGPCKMIAPILDEIADEYQGKLTVAKLNI
DQNPGTAPKYGIRGIPTLLLFKNGEVAATKVGALSKGQLKEFLDANLA

OST260
METDTLLLWVLLLWVPGSTGDGSMSDKIIHLTDDSFDTDVLKADGAILVDFWA
EWCGPNSGWRWCGRCGALWWRRVTSGPCKMIAPILDEIADEYQGKLTVAKLNI
DQNPGTAPKYGIRGIPTLLLFKNGEVAATKVGALSKGQLKEFLDANLA

OST261
METDTLLLWVLLLWVPGSTGDGSMSDKIIHLTDDSFDTDVLKADGAILVDFWA
EWCGPNSEVRQVTCIRCRRGFLLTSGPCKMIAPILDEIADEYQGKLTVAKLNI
DQNPGTAPKYGIRGIPTLLLFKNGEVAATKVGALSKGQLKEFLDANLA

OST262
METDTLLLWVLLLWVPGSTGDGSMSDKIIHLTDDSFDTDVLKADGAILVDFWA
EWCGPNSGGGGMIWEAWSCYACGTSGPCKMIAPILDEIADEYQGKLTVAKLNI
DQNPGTAPKYGIRGIPTLLLFKNGEVAATKVGALSKGQLKEFLDANLA

OST263
METDTLLLWVLLLWVPGSTGDGSMSDKIIHLTDDSFDTDVLKADGAILVDFWA
EWCGPNSLWIGPGDQGLFRRFVFTSGPCKMIAPILDEIADEYQGKLTVAKLNI
DQNPGTAPKYGIRGIPTLLLFKNGEVAATKVGALSKGQLKEFLDANLA

OST264
METDTLLLWVLLLWVPGSTGDGSVSSDQNHFRGEIEETITESFGNDHSTLDGY
SRRTTLSSKMYHTKGQEGSVCLRSSDCASGLCCARHFWSKICKPVLKEGQVCT
KHRRKGSHGLEIFQRCYCGEGLSCRIQKDHHQASNSSRLHTCQRH

FIG. 44A

OST265
METDTLLLWVLLLWVPGSTGDGSCASPTRGGDAGVQICLACRKRRKRCMRHAM
CCPGNYCKNGICVSSDQNHFRGEIEETITESFGNDHSTLDGYSRRTTLSSKMY
HTKGQEGSVCLRSSDCASGLCCARHFWSKICKPVLKEGQVCTKHRRKGSHGLE
IFQRCYCGEGLSC.

OST266
MGDKIIHLTDDSFDTDVLKADGAILVDFWAEWCGPNSYAWLFSCSRCRWWLPW
TSGPCKMIAPILDEIADEYQGKLTVAKLNIDQNPGTAPKYGIRGIPTLLLFKN
GEVAATKVGALSKGQLKEFLDANLA

OST267
MGDKIIHLTDDSFDTDVLKADGAILVDFWAEWCGPNSICEVVRLWSRYPWSWV
TSGPCKMIAPILDEIADEYQGKLTVAKLNIDQNPGTAPKYGIRGIPTLLLFKN
GEVAATKVGALSKGQLKEFLDANLA

OST268
MGDKIIHLTDDSFDTDVLKADGAILVDFWAEWCGPNSGCTSAVCGAWAEAGRF
YCTSGPCKMIAPILDEIADEYQGKLTVAKLNIDQNPGTAPKYGIRGIPTLLLF
KNGEVAATKVGALSKGQLKEFLDANLA

OST269
MGDKIIHLTDDSFDTDVLKADGAILVDFWAEWCGPNSLWIGPGDQGLFRRFVF
TSGPCKMIAPILDEIADEYQGKLTVAKLNIDQNPGTAPKYGIRGIPTLLLFKN
GEVAATKVGALSKGQLKEFLDANLA

FIG. 44B

FIG. 48
Aptamers 261 and 262 from the LRP5-LBD Activate Wnt Signaling in Xenopus
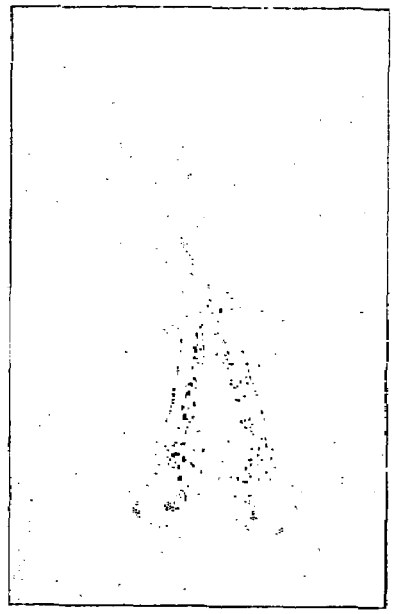
261 - LBD-Binding Peptide
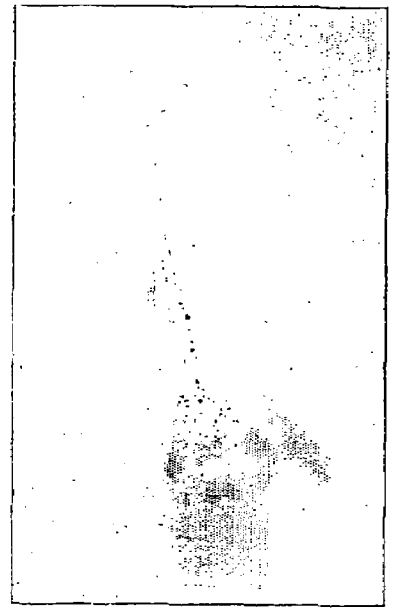
262 - LBD-Binding Peptide
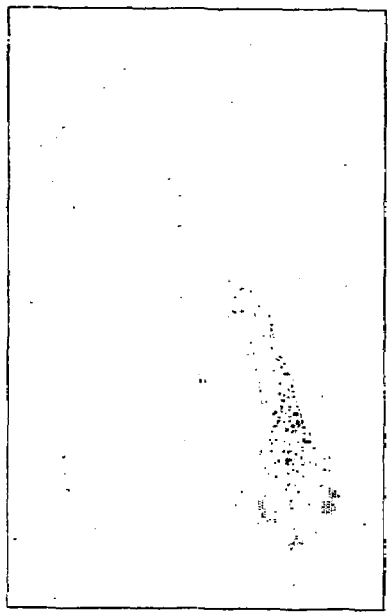
263 - Negative Control
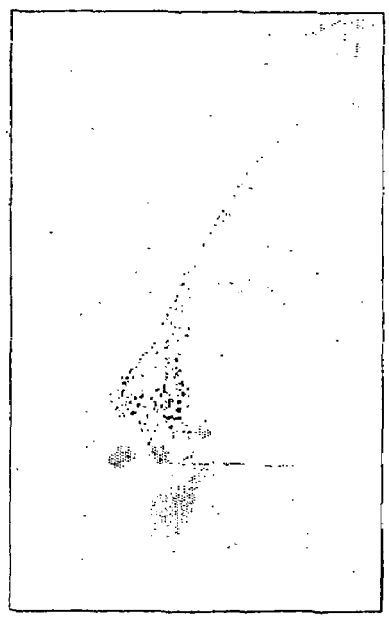
262 - LBD-Binding Peptide LY   propeller blade (YWTD "domain"/repeat 1-43-45 aa ae ea./~265/prop.])
EGF  epidermal growth factor-like domain [~42 aa]
LA   LDL receptor class A module [~38 aa]
TM   transmembrane helix [22 aa]
ICD  intracellular domain [107 aa]

Blades 1 @ = BOLD DOUBLE UNDERLINE UPPERCASE   Blades 2 @ = "lower case – dashed box"

Blades 3 @ = BOLD UPPERCASE BOX   Blades 4 @ = double underline lower case

Blades 5 @ = BOLD UPPERCASE DASHED UNDERLINE   Blades 6 @ = double underline bold lower case Top loops @ bold lower case   Bottom loops @ BOLD UPPER CASE

```
AF064984m_ywtd6a    -ASPLLLFANRRDVRLVDAGGVKL-----ESTIVASGLEDAAAVDFQFSKGAVYWTDVSEE
AF077847m_ywtd6a    -ASPLLLFANRRDVRLVDAGGVKL-----ESTIVASGLEDAAAVDFQFSKGAVYWTDVSEE
AF077820h_ywtd6a    -ASPLLLFANRRDVRLVDAGGVKL-----ESTIVVSGLEDAAAVDFQFSKGAVYWTDVSEE
AF074264h_ywtd6a    --APLLLYANRRDLRLVDATNGKE-----NATIVVGGLEDAAAVDFVFSHGLIYWSDVSEE
AF074265m_ywtd6a    --APLLLYANRRDLRLVDATNGKE-----NATIVVGGLEDAAAVDFVFGHGLIYWSDVSEE
1lpx                DEEPFLIFANryYLRKLNLDGS------NXTLLKQglnnavaldfiDYREQmiywtdvttq
af064984m_ywtd6c    -PEAFLVFTSRATIHRISLETNNN-----DVAIPLTGVKEASALDFDVSNNHIYWTDVSLK
af077820h_ywtd6c    -PEAFLVFTSRAAIHRISLETNNN-----DVAIPLTGVKEASALDFDVSNNHIYWTDVSLK
af074264h_ywtd6c    -PEAFLLFSRRADIRRISLETNNN-----NVAIPLTGVKEASALDFDVTDNRIYWTDISLK
af074265m_ywtd6c    -PEAFLLFSRRADIRRISLETNNN-----NVAIPLTGVKEASALDFDVTDNRIYWTDISLK
af064984m_ywtd6b    GAEEVLLLARRTDLRRISLDTPDF-----TDIVLQVGDIRHAIAIDYDPLEGYVYWTDDEVR
af077820h_ywtd6b    ---EVLLLARRTDLRRISLDTPDF-----TDIVLQVDDIRHAIAIDYDPLEGYVYWTDDEVR
af074264h_ywtd6b    GATELLLLARRTDLRRISLDTPDF-----TDIVLQLEDIRHAIAIDYDPVEGYIYWTDDEVR
af074265m_ywtd6b    GATELLLLARRTDLRRISLDTPDF-----TDIVLQLEDIRHAIAIDYDPVEGYIYWTDDEVR
1ndx                PPGTHLLFAQtgKIERLPLEGNTMRKTEAKAFLHvpakviiglafiDCVDKmvywtditep
af064984m_ywtd6d    -PSTFLLFSQKFAISRMIPDDQLS---PDLVLPLHGLRNVKAINYDPLDKFIYWDGRQN
af077820h_ywtd6d    -PTTFLLFSQKSAISRMIPDDQHS---PDLILPLHGLRNVKAIDYDPLDKFIYWDGRQN
```

FIG. 51A

```
af074264h_ywtd6d   -PTTFLLFSQKSAINRMVIDEQQS----PDIILPIHSLRNVRAIDYDPLDKQLYWIDSRQN
af074265m_ywtd6d   -PSTFLLFSQKSAINRMVIDEQQS----PDIILPIHSLRNVRAIDYDPLDKQLYWIDSRQN
DSC_SEC            -CCCEEHHHHCCCCEEEECCCCCCC---CEEEECCCCEEEECCCCCEEEEECCCCCEECCHH
PROB_H             -1124359854444432121211110----00000243443100011111110000011257
PROB_E             -00256301010101116653211111----299996110115699754221358886322211
PROB_C             -996112115565551245788899----811125666552311345778642224467642
AF064984m_ywtd6a   AIKQTYLNQTG----AAAQNIVISGLVSPDGLACDWVGKKLYWTDSETNRIEVANLNGTS
AF077847m_ywtd6a   AIKQTYLNQTG----AAAQNIVISGLVSPDGLACDWVGKKLYWTDSETNRIEVANLNGTS
AF077820h_ywtd6a   AIKQTYLNQTG----AAVQNVVISGLVSPDGLACDWVGKKLYWTDSETNRIEVANLNGTS
AF074264h_ywtd6a   AIKRTEFNKT-----ESVQNVVVSGLLSPDGLACDWLGEKLYWTDSETNRIEVSNLDGSL
AF074265m_ywtd6a   AIKRTEFNKS-----ESVQNVVVSGLLSPDGLLSPDGLACDWLGEKLYWTDSETNRIEVSNLDGSL
1lpx               gsmirrmhING---snvqvlhrtglsnPDGLAVDWVGGNLYWCdkgrdTIEVSKLNGAY
af064984m_ywtd6c   TISRAFMNGS-----SVEHVIEFGLDYPEGMAVDWMGKNLYWADTGTNRIEVARLDGQF
af077820h_ywtd6c   TISRAFMNGS-----SVEHVIEFGLDYPEGMAVDWMGKNLYWADTGTNRIEVARLDGQF
af074264h_ywtd6c   TISRAFMNGS-----ALEHVVEFGLDYPEGMAVDWLGKNLYWADTGTNRIEVSKLDGQH
af074265m_ywtd6c   TISRAFMNGS-----ALEHVVEFGLDYPEGMAVDWLGKNLYWADTGTNRIEVSKLDGQH
af064984m_ywtd6b   AIRRAYLDGS-----GAQTLVNTEINDPDGIAVDWVARNLYWTDTGTDRIEVTRLNGTS
af077820h_ywtd6b   AIRRAYLDGS-----GAQTLVNTEINDPDGIAVDWVARNLYWTDTGTDRIEVTRLNGTS
af074264h_ywtd6b   AIRRSFIDGS-----GSQFVVTAQIAHPDGIAVDWVARNLYWTDTGTDRIEVTRLNGTM
af074265m_ywtd6b   AIRRSFIDGS-----GSQFVVTAQIAHPDGIAVDWVARNLYWTDTGTDRIEVTRLNGTM
1ndx               sigrasLHGG-----Epttiirqdlgs PEGIAVDHLGRNIFWTDsnldrIEVAKLDGTQ
af064984m_ywtd6d   -IKRAKDDGTQPS-MLTSPSQSLSPDRQPHDLSIDIYSRTLFWTCEATNTINVHRLDGDA
af077820h_ywtd6d   -IKRAKDDGTQPF-VLTSLSQGQNPDRQPHDLSIDIYSRTLFWTCEATNTINVHRLSGEA
af074264h_ywtd6d   MIRKAQEDGSQGFTVVVSSVPSQNLEIQPYDLSIDIYSRYIYWTCEATNVINVTRLDGRS
```

FIG. 51B

```
af074265m_ywtd6d         SIRKAHEDGGQGFNVVANSVANQNLEIQPYDLSIDIYSRYIYWTCEATNVIDVTRLDGRS
DSC_SEC                  HHHHEEECCCC----CCCEEEEECCCCCCEEEEEECCCCEEEEEEEEEEEEEEEECCCC
PROB_H                   9995321111111131000011111111100132220001111110000221112
PROB_E                   0013565211112379999642111257965323367751001699996300011
PROB_C                   1102224788887421113578888743132465534889831111259997
                                             *
AF064984m_ywtd6a         RKVLFWQDLDQPRAIALDPAHGYMYWTDWG-EAPRIERAGMDGSTRKIIVDSDIYWPNGL
AF077847m_ywtd6a         RKVLFWQDLDQPRAIALDPAHGYMYWTDWG-EAPRIERAGMDGSTRKIIVDSDIYWPNGL
AF077820h_ywtd6a         RKVLFWQDLDQPRAIALDPAHGYMYWTDWG-ETPRIERAGMDGSTRKIIVDSDIYWPNGL
AF074264h_ywtd6a         RKVLFWQELDQPRAIALDPSSGFMYWTDWG-EVPKIERAGMDGSSRFIINSEIYWPNGL
AF074265m_ywtd6a         RKVLFWQELDQPRAIALDPSSGFMYWTDWG-EVPKIERAGMDGSSRFVIINTEIYWPNGL
11px                     RTVLVN sglre PRAIVVDVQNGYLYWTDwg-dhs LIGKIGMDGTNRSVIVdtki twPNGL
af064984m_ywtd6c         RQVLVWRDLDNPRSLALDPTKGYIYWTEWG-GKPRIVRAFMDGTNCMTLVD-KVGRANDL
AF077820h_ywtd6c         RQVLVWRDLDNPRSLALDPTKGYIYWTEWG-GKPRIVRAFMDGTNCMTLVD-KVGRANDL
af074264h_ywtd6c         RQVLVWKDLDSPRALALDPAEGFMYWTEWG-GKPKIDRAAMDGSERTTLVP-NVGRANGL
af074265m_ywtd6c         RQVLVWKDLDSPRALALDPAEGFMYWTEWG-GKPKIDRAAMDGSERTTLVP-NVGRANGL
af064984m_ywtd6b         RKILVSEDLDEPRAIVLHPVMGLMYWTDWG-ENPKIECANLDGRDRHVLVNTSLGWPNGL
af077820h_ywtd6b         RKILVSEDLDEPRAIALHPVMGLMYWTDWG-ENPKIECANLDGQERRVLVNASLGWPNGL
af074264h_ywtd6b         RKILISEDLEEPRAIVLDPMVGYMYWTDWG-EIPKIERAALDGSDRVVLVNTSLGWPNGL
af074265m_ywtd6b         RKILISEDLEEPRAIVLDPMVGYMYWTDWG-EIPKIERAALDGSDRVVLVNTSLGWPNGL
ndx                      RRVL fetdlvn PRGIVTDSVRGNLYWTDwnrdnp KIETSYMDGTNRRILV qddlg lPNGL
af064984m_ywtd6d         MGVVLRGDRDKPRAIAVNAERGYMYFTNMQDHAAKIERASLDGTEREVLFTTGLIRPVAL
af077820h_ywtd6d         MGVVLRGDRDKPRAIAVNAERGYMYFTNMQDHAAKIERASLDGTEREVLFTTGLIRPVAL
af074264h_ywtd6d         MGVVLRGDRDKPRAIVVNAERGYLYFTNMQDRAAKIERAALDGTEREVLFTTGLIRPVAL
af074265m_ywtd6d         VGVVLKGEQDRPRAIVVNPEKGYMYFTNLQERSPKIERAALDGTEREVLFFSGLSKPIAL
```

FIG. 51C

```
af074265m_ywtd6d                    VGVVLKGEQDRPRAIVVNPEKGYMYFTNLQERSPKIERAALDGTEREVLFFSGLSKPIAL
DSC_SEC                             CEEEEECCCCCCCCCEEECCCCCCEEEEEECCCCCCEEEEEEEEECCCCCCCCC
PROB_H                              331102433213441111211100011111-11254756421112000000011112
PROB_E                              35999611100111765110015999620-0012332321100149999822111123
PROB_C                              42001256689655234878984113799-997331225799974111288898875
AF064984m_ywtd6a                    TIDLEEQKLYWADAKLSFIHRANLDGSFRQKVVEGSLTHPFALTLSGDTLYWTDWQTRSI
AF077847m_ywtd6a                    TIDLEEQKLYWADAKLSFIHHANLDGSFRQKVVEGSLTHPFALTLSGDTLYWTDWQTRSI
AF077820h_ywtd6a                    TIDLEEQKLYWADAKLSFIHRANLDGSFRQKVVEGSLTHPFALTLSGDTLYWTDWQTRSI
AF074264h_ywtd6a                    TLDYEEQKLYWADAKLNFIHKSNLDGTNRQAVVKGSLPHPFALTLFEDILYWTDWSTHSI
AF074265m_ywtd6a                    TLDYQERKLYWADAKLNFIHKSNLDGTNRQAVVKGSLPHPFALTLFEDTLYWTDWNTHSI
1lpx                                TLDYINSRIYWADaredYIEFASLDGSNRHTVLSqdiphifaltlFEDyiywtdwetksi
af064984m_ywtd6c                    TIDYADQRLYWTDLDTNMIESSNMLGQER-MVIADDLPYPFGLTQYSDYIYWTDWNLHSI
af077820h_ywtd6c                    TIDYADQRLYWTDLDTNMIESSNMLGQER-VVIADDLPHPFGLTQYSDYIYWTDWNLHSI
af074264h_ywtd6c                    TIDYAKRRLYWTDLDTNLIESSNMLGLNR-EVIADDLPHPFGLTQYQDYIYWTDWSRRSI
af074265m_ywtd6c                    TIDYAKRRLYWTDLDTNLIESSDMLGLNR-EVIADDLPHPFGLTQYQDYIYWTDWSRRSI
af064984m_ywtd6b                    ALDLQEGKLYWGDAKTDKIEVINIDGTKRKTLLEDKLPHIFGFTLLGDFIYWTDWQRRSI
af077820h_ywtd6b                    ALDLQEGKLYWGDAKTDKIEVINVDGTKRRTLLEDKLPHIFGFTLLGDFIYWTDWQRRSI
af074264h_ywtd6b                    ALDYDEGKIYWGDAKTDKIEVMNTDGTGRRVLVEDKIPHIFGFTLLGDYVYWTDWQRRSI
af074265m_ywtd6b                    ALDYDEGTIYWGDAKTDKIEVMNTDGTGRRVLVEDKIPHIFGFTLLGDYVYWTDWQRRSI
Hndx                                HFDAFSSQLCWDagtnRAECLNPSQPSRRKAleg-lqypfavtSYGKnlyftdwkmnsv
af064984m_ywtd6d                    VVDNALGKLFWVDADLKRIESCDLSGANRLTLEDANIVQPVGLTVLGRHLYWIDRQQQMI
af077820h_ywtd6d                    VVDNTLGKLFWVDADLKRIESCDLSGANRLTLEDANIVQPLGLTILGKHLYWIDRQQQMI
af074264h_ywtd6d                    ALDSRLGKLFWADSDLRRIESSDLSGANRIVLEDSNILQPVGLTVFENWLYWIDKQQQMI
af074265m_ywtd6d                    ALDSKLGKLFWADSDLRRIESSDLSGANRIVLEDSNILQPVGLTVFENWLYWIDKQQQMI
DSC_SEC                             CCCCCCCCEEEECCCCCCEEEECCCCCCCEEEECCCCCCCCCCCEEECCCCCCHHH
```

```
                          11344443310011112444332112121122411101211111110002112211112224577
                          44311113799522121555652100011489632111245663211366642110111
                          5455564211477865122247799875511357888754445787533567  76422
PROB_H
PROB_E
PROB_C
AF064984m_ywtd6a          HACNKWTGEQRKEILSALYSPMDIQVLSQERQPPFHT
AF077847m_ywtd6a          HACNKWTGEQRKEILSALYSPMDIQVLSQERQPPFHT
AF077820h_ywtd6a          HACNKRTGGKRKEILSALYSPMDIQVLSQERQPFFHT
AF074264h_ywtd6a          LACNKYTGEGLREIHSDIFSPMDIHAFSQQRQPNA--
AF074265m_ywtd6a          LACNKYTGEGLREIHSNIFSPMDIHAFSQQRQPNA--
1lpx                      nrahKTTGanktllistlhrPMDIHIYHPYR------
af064984m_ywtd6c          ERADKTSGRNRTLIQGHLDFVMDILVFHSSRQDGL--
af077820h_ywtd6c          ERADKTSGRNRTLIQGHLDFVMDILVFHSSRQDGL--
af074264h_ywtd6c          ERANKTSGQNRTIIQGHLDYVMDILVFHSSRQSG---
af074265m_ywtd6c          ERANKTSGQNRTIIQGHLDYVMDILVFHSSRQAG---
af064984m_ywtd6b          ERVHKVK-ASRDVIIDQLPDLMGLKAVNVAKVVGT--
af077820h_ywtd6b          ERVHKVK-ASRDVIIDQLPDLMGLKAVNVAKVVGT--
af074264h_ywtd6b          ERVHKRS-AEREVIIDQLPDLMGLKATNVHRVIG---
af074265m_ywtd6b          ERVHKRS-AEREVIIDQLPDLMGLKATSVHRVIG---
1ndx                      valdLAISketdafqphkqtrLYGITTALSQCP-----
af064984m_ywtd6d          ERVEKTTGDKRTRVQGRVTHLTGIHAVEEVSLEEFSA
af077820h_ywtd6d          ERVEKTTGDKRTRIQGRVAHLTGIHAVEEVSLEEFSA
af074264h_ywtd6d          EKIDMTGREGRTKVQARIAQLSDIHAVKELNLQEYR-
af074265m_ywtd6d          EKIDMTGREGRTKVQARIAQLSDIHAVKELNLQEYR-
DSC_SEC                   HHHCCCCCCCCEEEECCCCCCEEEEECCCCCCCCCCC
PROB_H                    76644221123211223222211112332211101
PROB_E                    12112100136886432212256666321221111
PROB_C                    22355679974211244667674333244677 78898
```

Possible Effect of Functional Mutations on Side Chain Interactions
Wild Type
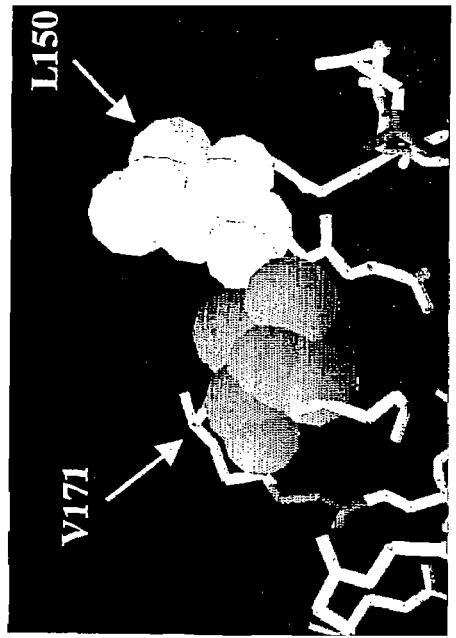
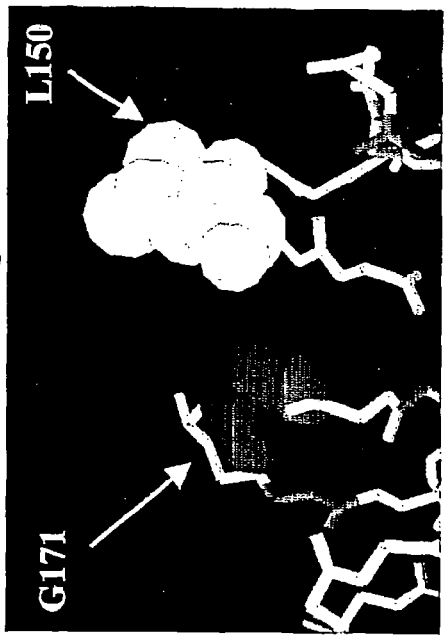
Mutant
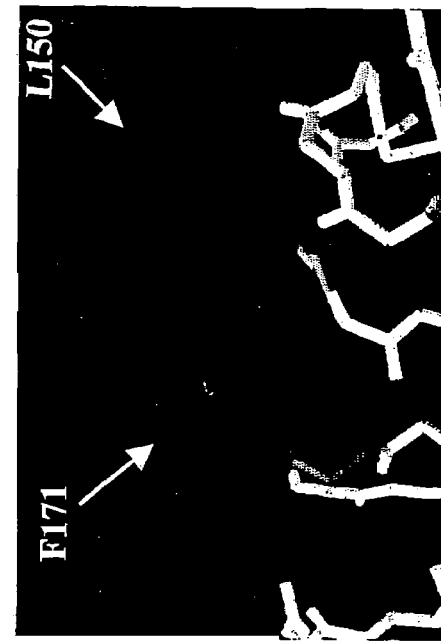
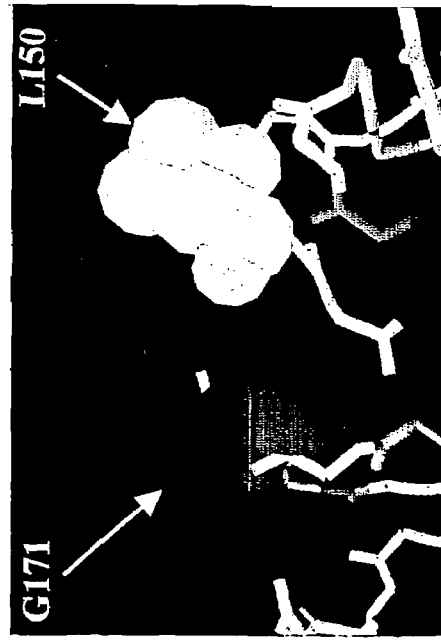
FIG. 52

Homology Model of LRP5's 2nd Propeller Domain
Propeller 2 Contains Two OPPG mutations

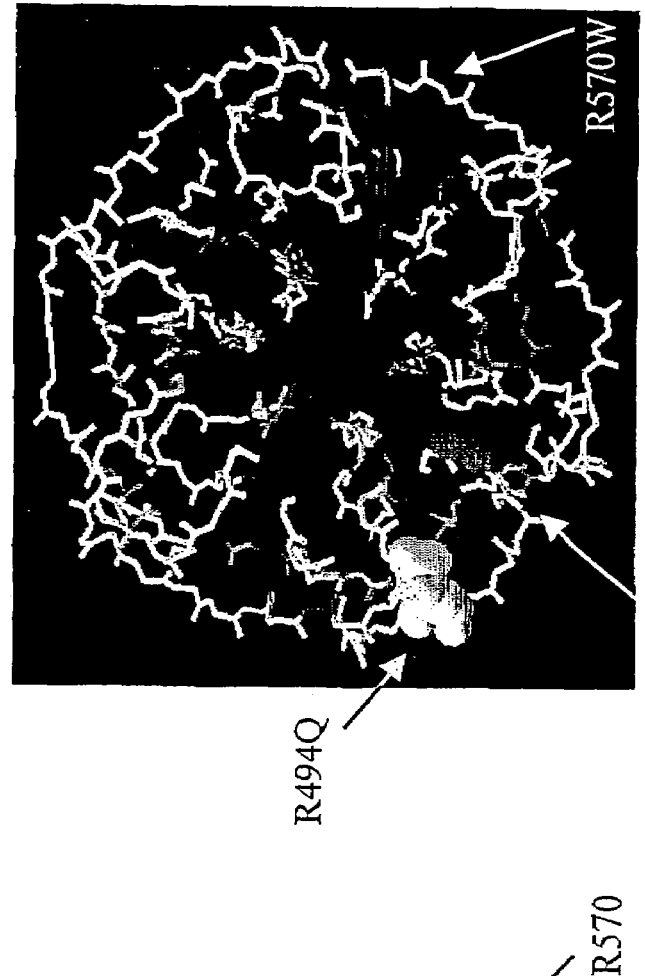
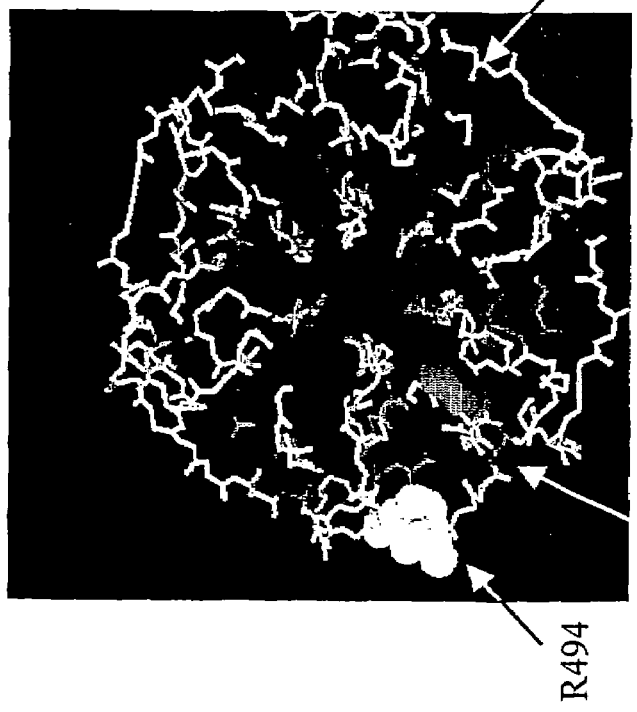
Homology Model of LRP5's 2nd Propeller Domain
Propeller 2 Contains Two OPPG mutations
FIG. 53B

US 7,416,849 B2

HBM VARIANTS THAT MODULATE BONE MASS AND LIPID LEVELS

This application claims priority under 35 U.S.C. §119 to Provisional Application No. 60/290,071, filed in the U.S. on May 11, 2001, to Provisional Application No. 60/291,311, filed in the United States on May 17, 2001, to Provisional Application No. 60/353,058, filed in the U.S. on Feb. 1, 2002 and to Provisional Application No. 60/361,293, filed in the U.S. on Mar. 4, 2002, the entire contents of which are hereby incorporated by reference.

SEQUENCE LISTING

The instant application contains a "lengthy" Sequence Listing which has been submitted via CD-R in lieu of a printed paper copy, and is hereby incorporated by reference in its entirety. Said CD-R, recorded on Sep. 14, 2007, are labeled CRF, "Copy 1" and "Copy 2", respectively, and each contains only one identical 999 KB file (47038187.TXT).

FIELD OF THE INVENTION

The present invention relates generally to the field of genetics, genomics and molecular biology. The invention relates to methods and materials used to isolate, detect and sequence a high bone mass gene and corresponding wild-type gene, and mutants thereof. The present invention also relates to the high bone mass (HBM) gene, the corresponding wild-type gene, and mutants thereof. The genes identified in the present invention are implicated in the ontology and physiology of bone development. The invention also provides nucleic acids, proteins, cloning vectors, expression vectors, transformed hosts, methods of developing pharmaceutical compositions, methods of identifying molecules involved in bone development, and methods of diagnosing and treating diseases involved in bone development and lipid levels. The invention further relates to transgenic animals for studying the HBM phenotype and related variant phenotypes, the mechanism of action of the HBM gene and its variants, and factors and treatments affecting normal and abnormal bone conditions. In preferred embodiments, the present invention is directed to methods for treating, diagnosing, preventing and screening for normal and abnormal conditions of bone, including metabolic bone diseases such as osteoporosis.

BACKGROUND OF THE INVENTION

Two of the most common types of osteoporosis are postmenopausal and senile osteoporosis. Osteoporosis affects men as well as women, and, taken with other abnormalities of bone, presents an ever-increasing health risk for an aging population. The most common type of osteoporosis is that associated with menopause. Most women lose between 20-60% of the bone mass in the trabecular compartment of the bone within 3-6 years after the cessation of menses. This rapid loss is generally associated with an increase of bone resorption and formation. However, the resorptive cycle is more dominant and the result is a net loss of bone mass. Osteoporosis is a common and serious disease among postmenopausal women. There are an estimated 25 million women in the United States alone who are afflicted with this disease. The results of osteoporosis are both personally harmful, and also account for a large economic loss due to its chronicity and the need for extensive and long-term support (hospitalization and nursing home care) from the disease sequelae. This is especially true in more elderly patients. Additionally, while osteoporosis is generally not thought of as a life-threatening condition, a 20-30% mortality rate is related to hip fractures in elderly women. A large percentage of this mortality rate can be directly associated with postmenopausal osteoporosis. The costs alone associated with the treatment of osteoporotic fractures in the United States is $10 to $15 billion annually. Worldwide incidence of osteoporotic hip fractures is estimated to exceed 1.7 million cases.

The most vulnerable tissue in the bone to the effects of postmenopausal osteoporosis is the trabecular bone. This tissue is often referred to as spongy bone and is particularly concentrated near the ends of the bone near the joints and in the vertebrae of the spine. The trabecular tissue is characterized by small structures which inter-connect with each other as well as the more solid and dense cortical tissue which makes up the outer surface and central shaft of the bone. This crisscross network of trabeculae gives lateral support to the outer cortical structure and is critical to the biomechanical strength of the overall structure. In postmenopausal osteoporosis, it is primarily the net resorption and loss of the trabeculae which lead to the failure and fracture of the bone. In light of the loss of the trabeculae in postmenopausal women, it is not surprising that the most common fractures are those associated with bones which are highly dependent on trabecular support, e.g., the vertebrae, the neck of the femur, and the forearm. Indeed, hip fracture, Colle's fractures, and vertebral crush fractures are indicative of postmenopausal osteoporosis.

One of the earliest generally accepted methods for treatment of postmenopausal osteoporosis was estrogen replacement therapy. Although this therapy frequently is successful, patient compliance is low, primarily due to the undesirable side-effects of chronic estrogen treatment. Frequently cited side-effects of estrogen replacement therapy include reinitiation of menses, bloating, depression, and fear of breast or uterine cancer. In order to limit the known threat of uterine cancer in those women who have not undergone a hysterectomy, a protocol of estrogen and progestin cyclic therapy is often employed. This protocol is similar to that which is used in birth control regimens, and often is not tolerated by women because of the side-effects characteristic of progestin. More recently, certain antiestrogens, originally developed for the treatment of breast cancer, have been shown in experimental models of postmenopausal osteoporosis to be efficacious. Among these agents is raloxifene (See, U.S. Pat. No. 5,393, 763, and Black et al, *J. Clin. Invest.*, 93:63-69 (1994)). In addition, tamoxifene, a widely used clinical agent for the treatment of breast cancer, has been shown to increase bone mineral density in post menopausal women suffering from breast cancer (Love et al, *N. Engl. J. Med.*, 326:852-856 (1992)).

Another therapy for the treatment of postmenopausal osteoporosis is the use of calcitonin. Calcitonin is a naturally occurring peptide which inhibits bone resorption and has been approved for this use in many countries (Overgaard et al, *Br. Med. J.*, 305:556-561 (1992)). The use of calcitonin has been somewhat limited, however. Its effects are very modest in increasing bone mineral density and the treatment is very expensive. Another therapy for the treatment of postmenopausal osteoporosis is the use of bis-phosphonates. These compounds were originally developed for use in Paget's disease and malignant hypercalcemia. They have been shown to inhibit bone resorption. Alendronate, one compound of this class, has been approved for the treatment of postmenopausal osteoporosis. These agents may be helpful in the treatment of osteoporosis, but these agents also have potential liabilities which include osteomalacia, extremely long half-life in bone (greater than 2 years), and possible "frozen bone syndrome," e.g., the cessation of normal bone remodeling.

Senile osteoporosis is similar to postmenopausal osteoporosis in that it is marked by the loss of bone mineral density and resulting increase in fracture rate, morbidity, and associated mortality. Generally, it occurs in later life, i.e., after 70 years of age. Historically, senile osteoporosis has been more common in females, but with the advent of a more elderly male population, this disease is becoming a major factor in the health of both sexes. It is not clear what, if any, role hormones such as testosterone or estrogen have in this disease, and its etiology remains obscure. Treatment of this disease has not been very satisfactory. Hormone therapy, estrogen in women and testosterone in men, has shown equivocal results; calcitonin and bis-phosphonates may be of some utility.

The peak mass of the skeleton at maturity is largely under genetic control. Twin studies have shown that the variance in bone mass between adult monozygotic twins is smaller than between dizygotic twins (Slemenda et al, *J. Bone Miner. Res.,* 6:561-567 (1991); Young et al, *J. Bone Miner. Res.,* 6:561-567 (1995); Pocock et al, *J. Clin. Invest.,* 80:706-710 (1987); Kelly et al, *J. Bone Miner. Res.,* 8:11-17 (1993)), and it has been estimated that up to 60% or more of the variance in skeletal mass is inherited (Krall et al, *J. Bone Miner. Res.,* 10: S367 (1993)). Peak skeletal mass is the most powerful determinant of bone mass in elderly years (Hui et al, *Ann. Int. Med.,* 111:355-361 (1989)), even though the rate of age-related bone loss in adult and later life is also a strong determinant (Hui et al, *Osteoporosis Int.,* 1:30-34 (1995)). Since bone mass is the principal measurable determinant of fracture risk, the inherited peak skeletal mass achieved at maturity is an important determinant of an individual's risk of fracture later in life. Thus, study of the genetic basis of bone mass is of considerable interest in the etiology of fractures due to osteoporosis.

Recently, a strong interest in the genetic control of peak bone mass has developed in the field of osteoporosis. The interest has focused mainly on candidate genes with suitable polymorphisms to test for association with variation in bone mass within the normal range, or has focused on examination of genes and gene loci associated with low bone mass in the range found in patients with osteoporosis. The vitamin D receptor locus (VDR) (Morrison et al, *Nature,* 367:284-287 (1994)), PTH gene (Howard et al, *J. Clin. Endocrinol. Metab.,* 80:2800-2805 (1995); Johnson et al, *J. Bone Miner. Res.,* 8:11-17 (1995); Gong et al, *J. Bone Miner. Res.,* 10: S462 (1995)) and the estrogen receptor gene (Hosoi et al, *J. Bone Miner. Res.,* 10: S170 (1995); Morrison et al, *Nature,* 367: 284-287 (1994)) have figured most prominently in this work. These studies are difficult because bone mass (the phenotype) is a continuous, quantitative, polygenic trait, and is confounded by environmental factors such as nutrition, co-morbid disease, age, physical activity, and other factors. Also, this type of study design requires large numbers of subjects. In particular, the results of VDR studies to date have been confusing and contradictory (Garnero et al, *J. Bone Miner. Res.,* 10:1283-1288 (1995); Eisman et al, *J. Bone. Miner. Res.,* 10:1289-1293 (1995); Peacock, *J. Bone Miner. Res.,* 10:1294-1297 (1995)). Furthermore, the work thus far has not shed much light on the mechanism(s) whereby the genetic influences might exert their effect on bone mass.

While it is well known that peak bone mass is largely determined by genetic rather than environmental factors, studies to determine the gene loci (and ultimately the genes) linked to variation in bone mass are difficult and expensive. Study designs which utilize the power of linkage analysis, e.g., sib-pair or extended family, are generally more informative than simple association studies, although the latter do have value. However, genetic linkage studies involving bone mass are hampered by two major problems. The first problem is the phenotype, as discussed briefly above. Bone mass is a continuous, quantitative trait, and establishing a discrete phenotype is difficult. Each anatomical site for measurement may be influenced by several genes, many of which may be different from site to site. The second problem is the age component of the phenotype. By the time an individual can be identified as having low bone mass, there is a high probability that their parents or other members of prior generations will be deceased and therefore unavailable for study, and younger generations may not have even reached peak bone mass, making their phenotyping uncertain for genetic analysis.

Regardless, linkage analysis can be used to find the location of a gene causing a hereditary "disorder" and does not require any knowledge of the biochemical nature of the disorder, i.e., a mutated protein that is believed to cause the disorder does not need to be known. Traditional approaches depend on assumptions concerning the disease process that might implicate a known protein as a candidate to be evaluated. The genetic localization approach using linkage analysis can be used to first find the general chromosomal region in which the defective gene is located and then to gradually reduce the size of the region in order to determine the location of the specific mutated gene as precisely as possible. After the gene itself is discovered within the candidate region, the messenger RNA and the protein are identified and, along with the DNA, are checked for mutations.

The genetic localization approach has practical implications since the location of the disease can be used for prenatal diagnosis even before the altered gene that causes the disease is found. Linkage analysis can enable families, even many of those that do not have a sick child, to know whether they are carriers of a disease gene and to evaluate the condition of an unborn child through molecular diagnosis. The transmission of a disease within families, then, can be used to find the defective gene. As used herein, reference to "high bone mass" (HBM) is analogous to reference to a disease state, although from a practical standpoint high bone mass can actually help a subject avoid the disease known as osteoporosis.

Linkage analysis is possible because of the nature of inheritance of chromosomes from parents to offspring. During meiosis, the two parental homologues pair to guide their proper separation to daughter cells. While they are lined up and paired, the two homologues exchange pieces of the chromosomes, in an event called "crossing over" or "recombination." The resulting chromosomes are chimeric, that is, they contain parts that originate from both parental homologues. The closer together two sequences are on the chromosome, the less likely that a recombination event will occur between them, and the more closely linked they are. In a linkage analysis experiment, two positions on the chromosomes are followed from one generation to the next to determine the frequency of recombination between them. In a study of an inherited disease, one of the chromosomal positions is marked by the disease gene or its normal counterpart, i.e., the inheritance of the chromosomal region can be determined by examining whether the individual displays symptoms of the disorder or not. The other position is marked by a DNA sequence that shows natural variation in the population such that the two homologues can be distinguished based on the copy of the "marker" sequence that they possess. In every family, the inheritance of the genetic marker sequence is compared to the inheritance of the disease state. If, within a family carrying an autosomal dominant disorder such as high bone mass, every affected individual carries the same form of the marker and all the unaffected individuals carry at least one different form of the marker, there is a great probability that the disease gene and the marker are located close to each other. In this way, chromosomes may be systematically checked with known markers and compared to the disease state. The data obtained from the different families is combined, and analyzed together by a computer using statistical methods. The result is information indicating the probability of linkage between the genetic marker and the disease allowing different distances between them. A positive result can mean that the disease is very close to the marker, while a negative result indicates that it is far away on that chromosome, or on an entirely different chromosome.

Linkage analysis is performed by typing all members of the affected family at a given marker locus and evaluating the co-inheritance of a particular disease state with the marker probe, thereby determining how often the two of them are co-inherited. The recombination frequency can be used as a measure of the genetic distance between two gene loci. A recombination frequency of 1% is equivalent to 1 map unit, or 1 centiorgan (cM), which is roughly equivalent to 1,000 kb of DNA. This relationship holds up to frequencies of about 20% or 20 cM.

The entire human genome is 3,300 cM long. In order to find an unknown disease gene within 5-10 cM of a marker locus, the whole human genome can be searched with roughly 330 informative marker loci spaced at approximately 10 cM intervals (Botstein et al., *Am. J. Hum. Genet.,* 32:314-331 (1980)). The reliability of linkage results is established by using a number of statistical methods. The method most commonly used for the analysis of linkage in humans is the LOD score method (Morton, *Prog. Clin. Biol. Res.,* 147:245-265 (1984), Morton et al., *Am. J. Hum. Genet.,* 38:868-883 (1986)) which was incorporated into the computer program, LIPED, by Ott, *Am. J. Hum. Genet.,* 28:528-529 (1976). LOD scores are the logarithm of the ratio of the likelihood that two loci are linked at a given distance to that they are not linked (>50 cM apart). The advantage of using logarithmic values is that they can be summed among families with the same disease. This becomes necessary given the relatively small size of human families.

By convention, a total LOD score greater than +3.0 (that is, odds of linkage at the specified recombination frequency being 1000 times greater than odds of no linkage) is considered to be significant evidence for linkage at that particular recombination frequency. A total LOD score of less than −2.0 (that is, odds of no linkage being 100 times greater than odds of linkage at the specified frequency) is considered to be strong evidence that the two loci under consideration are not linked at that particular recombination frequency. Until recently, most linkage analyses have been performed on the basis of two-point data, which is the relationship between the disorder under consideration and a particular genetic marker. However, as a result of the rapid advances in mapping the human genome over the last few years, and concomitant improvements in computer methodology, it has become feasible to carry out linkage analyses using multi-point data. Multi-point analysis provide a simultaneous analysis of linkage between the disease and several linked genetic markers, when the recombination distance among the markers is known.

Multi-point analysis is advantageous for two reasons. First, the informativeness of the pedigree is usually increased. Each pedigree has a certain amount of potential information, dependent on the number of parents heterozygous for the marker loci and the number of affected individuals in the family. However, few markers are sufficiently polymorphic as to be informative in all those individuals. If multiple markers are considered simultaneously, then the probability of an individual being heterozygous for at least one of the markers is greatly increased. Second, an indication of the position of the disease gene among the markers may be determined. This allows identification of flanking markers, and thus eventually allows isolation of a small region in which the disease gene resides. Lathrop et al., *Proc. Natl. Acad. Sci. USA,* 81:3443-3446 (1984) have written the most widely used computer package, LINKAGE, for multi-point analysis.

There is a need in the art for identifying the gene associated with a high bone mass phenotype. There is also a need for tools for the study of the high bone mass gene and phenotype. More generally there is need for the development of diagnostic tools and treatments. The present invention is directed to these, as well as other, important ends.

SUMMARY OF THE INVENTION

It is an object of the invention to provide a nucleic acid comprising a mutation in LRP5 or LRP6 which results in a HBM phenotype when expressed in a cell, wherein said HBM phenotype results in bone mass modulation and/or lipid level modulation. Another embodiment contemplates that the mutation is located in propeller 1. In another embodiment, the nculeic acid encodes a mutation comprising at least one mutation of Tables 2 or 3 or which results in a mutation of one of the following G171V, A214V, A65V, M282V, G171K, G171F, G171I, G171Q, L200V, T201V, I202V, or S127V when expressed in a cell, and wherein expression of the nucleic acid in a subject results in bone mass modulation and/or lipid level modulation. In the instance of LRP6, the mutation is located in a position equivalent to LRP5 such that expression of the nucleic acid in a subject results in bone mass modulation and/or lipid level modulation. In another embodiment, the preferred mutation of LRP5 is G171V, A214V, A65V, M282V, G171K, G171F, G171I or G171Q or in an equivalent location if dealing with LRP6.

Another embodiment contemplated herein is a polypeptide encoded by any of the above nucleic acids, wherein said polypeptide when expressed in a cell modulates Wnt signaling, LRP5 activity and/or LRP6 activity. The polypeptide can additionally or alternatively modulate bone mass and/or lipid levels when expressed in a subject. These polypeptides or biologically active fragments thereof may preferably contain any of the following mutations of Table 2, G171V, A214V, A65V, M282V, G171K, G171F, G171I, G171Q, L200V, T201V, I202V, or S127V in LRP5 or in a equivalent location in LRP6. The most preferred mutations are G171V, A214V, A65V, M282V, G171K, G171F, G171I or G171Q in LRP5 or an equivalent location in LRP6.

Yet another embodiment contemplates antibodies an immunogenic fragments thereof which bind to these proteins. The contemplated antibodies include a monoclonal antibody, a chimeric antibody, a bispecific antibody, a humanized antibody, a primatized® antibody, a human antibody, or a labeled antibody. Preferably, some of the antibodies can discriminate between the wild type and variant forms of LRP5 and LRP6.

Another embodiment contemplates antibodies which bind to polypeptides comprising: $^{208}$KLYWADAKLSFIHRAN$^{223}$ (SEQ ID NO: 766), $^{277}$ALYSPMDIQVLSQER$^{291}$ (SEQ ID NO: 767), $^{61}$GLEDAAAVDFQFSKGA$^{73}$ (SEQ ID NO: 768), $^{234}$EGSLTHPFALTLSG$^{247}$ (SEQ ID NO: 769), $^{249}$TLYWTD-WQTRSIHACN$^{264}$ (SEQ ID NO: 770), $^{144}$VLFWQDLDQP-RAI$^{156}$ (SEQ ID NO: 771), $^{194}$IYWPNGLTIDLEEQKLY$^{210}$ (SEQ ID NO: 772), $^{34}$LLLFANRRDVRLVD$^{47}$ (SEQ ID NO: 773), $^{75}$GAVYWTDVSEEAIKQ$^{89}$ (SEQ ID NO: 774),

[121]KLYWTDSETNRIEVA[135] (SEQ ID NO: 775) of LRP5 or an equivalent domain on LRP6 or variants thereof.

The above antibodies can also be used in a composition for modulating bone mass and/or lipid levels in a subject comprising a therapeutically effective amount of the antibody or immunogenic fragment and a pharmaceutically acceptable carrier.

The invention further contemplates a method of diagnosing a HBM like phenotype in a subject comprising: (A) obtaining a biological sample from said subject; (B) exposing the sample to one of the described antibodies or immunogenic fragments; and (C) detecting whether the antibody bound a protein from the biological sample from said subject to determine whether the subject has a HBM-like phenotype.

Another embodiment contemplates a transgenic animal having somatic and/or germ cells comprising a nucleic acid which comprises a promoter region that directs protein expression in animal and/or human cells operably linked to any of the herein described nucleic acids, and wherein said transgenic animal has at least three bone parameters modulated by the expression of said nucleic acid. The promoter region can be selected from the group consisting of CMV, RSV, SV40, and EF-1a, CMVβbActin, histone, type I collagen, TGFβ1, SX2, cfos/cjun, Cbfa1, Fra/Jun, Dlx5, osteocalcin, osteopontin, bone sialoprotein, and collagenase promoter regions.

A further embodiment of the invention contemplates an animal model for the study of bone density modulation and/or lipid level modulation comprising a first group of animals composed of any of the described transgenic animals and a second group of control animals.

Another embodiment provides for a method of identifying agents which modulate the activity of an HBM-like nucleic acid comprising: (A) transfecting a cell with a vector of claim 11; (B) exposing the transfected cell of step (A) to a compound; and (C) determining whether the compound modulates the activity of the HBM-like nucleic acid. Such agents can include a hormone, a growth factor, a peptide, RNA, siRNA, DNA, a mineral, a vitamin, a natural product, or a synthetic organic compound.

Another aspect of the invention provides for a method for identifying compounds which modulate the interaction of Dkk with the Wnt signaling pathway comprising: (A) transfecting cells with constructs containing any of the described nucleic acids; (B) assessing changes in expression of a reporter element linked to a Wnt-responsive promoter; and (C) identifying as a Dkk/Wnt interaction modulating compound any compound which alters reporter gene expression compared with cells transfected with a Dkk construct alone. The cells are preferably cancer cells, liver cells or bone cells. The reporter element used is TCF-luciferase, tk-Renilla, or a combination thereof.

Yet another embodiment includes a method of diagnosing a subject as expressing a nucleic acid comprising a nucleotide change of Tables 2 or 3 or any other mutations, the method comprising the steps of: (A) obtaining a biological sample from the subject; and (B) assaying for the presence of the nucleotide change which results in HBM phenotype.

The invention also provides agents identified by the above methods which regulate Wnt activity, Dkk activity, bone mass and/or lipid levels.

BRIEF DESCRIPTION OF THE FIGURES

FIG. 2 depicts the BAC/STS content physical map of the HBM region in 11q13.3. STS markers derived from genes, ESTs, microsatellites, random sequences, and BAC end sequences are denoted above the long horizontal line. For markers that are present in GDB the same nomenclature has been used. Locus names (D11S####) are listed in parentheses after the primary name if available. STSs derived from BAC end sequences are listed with the BAC name first followed by L or R for the left and right end of the clone, respectively. The two large arrows indicate the genetic markers that define the HBM critical region. The horizontal lines below the STSs indicate BAC clones identified by PCR-based screening of a nine-fold coverage BAC library. Open circles indicate that the marker did not amplify the corresponding BAC library address during library screening. Clone names use the following convention: B for BAC, the plate, row and column address, followed by -H indicating the HBM project (i.e., B36F16-H).

FIGS. 3A-3F show the genomic structure of Zmax1 (LRP5) with flanking intron sequences. Translation is initiated by the underlined "ATG" in exon 1. The site of the polymorphism in the HBM gene is in exon 3 and is represented by the underlined "G," whereby this nucleotide is a "T" in the HBM gene. The 3' untranslated region of the mRNA is underlined within exon 23 (exon 1, SEQ ID NO:40; exon 2, SEQ ID NO:41; exon 3, SEQ ID NO:42; exon 4, SEQ ID NO:43; exon 5, SEQ ID NO:44; exon 6, SEQ ID NO:45; exon 7, SEQ ID NO:46; exon 8, SEQ ID NO:47; exon 9, SEQ ID NO:48; exon 10, SEQ ID NO:49; exon 11, SEQ ID NO:50; exon 12, SEQ ID NO:51; exon 13, SEQ ID NO:52; exon 14, SEQ ID NO:53; exon 15, SEQ ID NO:54; exon 16, SEQ ID NO:55; exon 17, SEQ ID NO:56; exon 18, SEQ ID NO:57; exon 19, SEQ ID NO:58; exon 20, SEQ ID NO:59; exon 21, SEQ ID NO:60; exon 22, SEQ ID NO:61; and exon 23; SEQ ID NO:62).

FIG. 4 shows the domain organization of Zmax1 (LRP5), including the YWTD spacers (YWTD disclosed as SEQ ID NO: 1087), the extracellular attachment site, the binding site for LDL and calcium, the cysteine-rich growth factor repeats, the transmembrane region, the ideal PEST region with the CK-II phosphorylation site and the internalization domain. FIG. 4 also shows the site of the glycine to valine change that occurs in the HBM protein. The signal peptide is located at amino acids 1-31, the extracellular domain is located at amino acids 32-1385, the transmembrane segment is located at amino acids 1386-1413, and the cytoplasmic domain is located at amino acids 1414-1615.

FIGS. 6A-6J are the nucleotide (SEQ ID NO:1) and amino acid (SEQ ID NO:3) sequences of the wild-type gene, Zmax1 (LRP5). The location for the base pair substitution at nucleotide 582, a guanine to thymine, (SEQ ID NO: 2 and 4) is underlined. This allelic variant is the HBM gene. The HBM gene encodes for a protein with an amino acid substitution of glycine to valine at position 171. The 5' untranslated region (UTR) boundaries bases 1 to 70, and the 3' UTR boundaries bases 4916-5120.

FIG. 17 confirms expression by the transgenic (i.e., HBM-MCBA and HBMMTIC) and wild-type (i.e., ZmaxWTCBA and ZmaxWTTIC) plasmid constructs. These constructs were transiently transfected into HOB-02-02 cells and the mRNA levels determined using TaqMan® quantitative PCR. HBMMCBA and ZmaxWTCBA are shown in the left column (i.e. CMVβActin) and HBMMTIC and ZmaxWTTIC are shown in the right column (i.e. Type I collagen) of the Table.

FIG. 22 depicts changes in BMD in HBM transgenic mice (i.e., HBMMCBA and HBMMTIC constructs) at 5 weeks using in vivo pDXA* analysis. The BMD changes are presented as compared to wild-type animals which were also only 5 weeks old.

FIG. 23 depicts changes in BMD in HBM transgenic nice (i.e., HBMMCBA and HBMMTIC constructs) at 9 weeks using in vivo pDXA* analysis. The BMD changes are presented as compared to wild-type animals which were also only 9 weeks old.

FIGS. 24(A-D) presents the sequence of the insert of the gene, HBMGI_2AS, subcloned into the vector (SEQ ID NO:759).

FIGS. 25(A-D) presents the sequence of the insert of the gene, ZMAXGI_3AS, subcloned into the vector (SEQ ID NO:760).

FIGS. 26(A-C) presents an alignment of human (SEQ ID NO:761) and mouse (SEQ ID NO:762) Zmax1 (LRP5) amino acid sequences.

FIGS. 27(A-C) presents an alignment of human LRP5 (Zmax1) (SEQ ID NO:763) and LRP6 (SEQ ID NO:764) amino acid sequences.

FIG. 31 shows a table of proteins identified in a Y2H screen using a Dkk-1 bait sequence. These proteins are identified by both their nucleic acid and amino acid accession numbers.

FIG. 35 shows the effects of Zmax/LRP5 and HBM on induction of secondary axis formation in the *Xenopus* embryo assay.

FIG. 38 shows a table of peptide aptamer insert sequences (SEQ ID NOS: 1089-1092, respectively, in order of appearance) identified in a Y2H screen using a LRP5 ligand binding domain bait sequence.

FIG. 39 shows pcDNA3.1 construct names with nucleotide sequences (SEQ ID NOS: 1008-1019, respectively, in order of appearance) for LRP5-binding peptide aptamers, Dkk-1 peptides and control constructs.

FIG. 44 shows the amino acid sequences (SEQ ID NOS: 1020-1031. respectively, in order of appearance) for the corresponding LRP5-binding peptides, Dkk-1 peptide aptamers and control constructs in FIG. 39.

FIG. 48 shows the morphological results in the *Xenopus* assay using aptamers 261 and 262 from the LRP5-LBD to activate Wnt signaling.

FIG. 51 CLUSTALW (1.8) multiple sequence alignment of the β-propeller segments of LRP5 from human (af077820 h) and mouse (af064984 m and af077847 m), LRP6 from human (af074264 h) and mouse (af074265 m), and the sequences from proteins with modeled 6-bladed β-propellers: chicken LRP1(11 px) and human nidogen (1 ndx). For the LPRs, the final suffix letter designates which of the four propeller domains the sequence comes from (a=>prop. #1, b=>prop. #2, etc.). The final four lines give the secondary structure assignments predicted by DSC for all sequences given in this alignment (H=helix, E=strand and C=coil) and the weights assigned to each structural type at each position on a scale of 0 (least probable) to 9 (most probable). Sequences corresponding to Springer's models'strand positions are underlined and color-coded according to which of the six blades they belong to. In the propeller geometry, alternate loops fall on opposite faces of the disc-shaped domain. The loops on the "top" face (i.e., opposite the points of entry and exit of the chain from the structure) are colored red. The position of the G171V mutation is marked with "*" FIG. discloses SEQ ID NOS: 1093-1111, respectively, in order of appearance.

FIG. 52 displays the functional effect of mutations on side chain interactions in HBM protein as compared the wild-type Zmax1 (LRP5) protein. It also shows the side chain interactions of G171F, an HBM like variant.

DETAILED DESCRIPTION OF THE INVENTION

1. Definitions

Figure 1A:
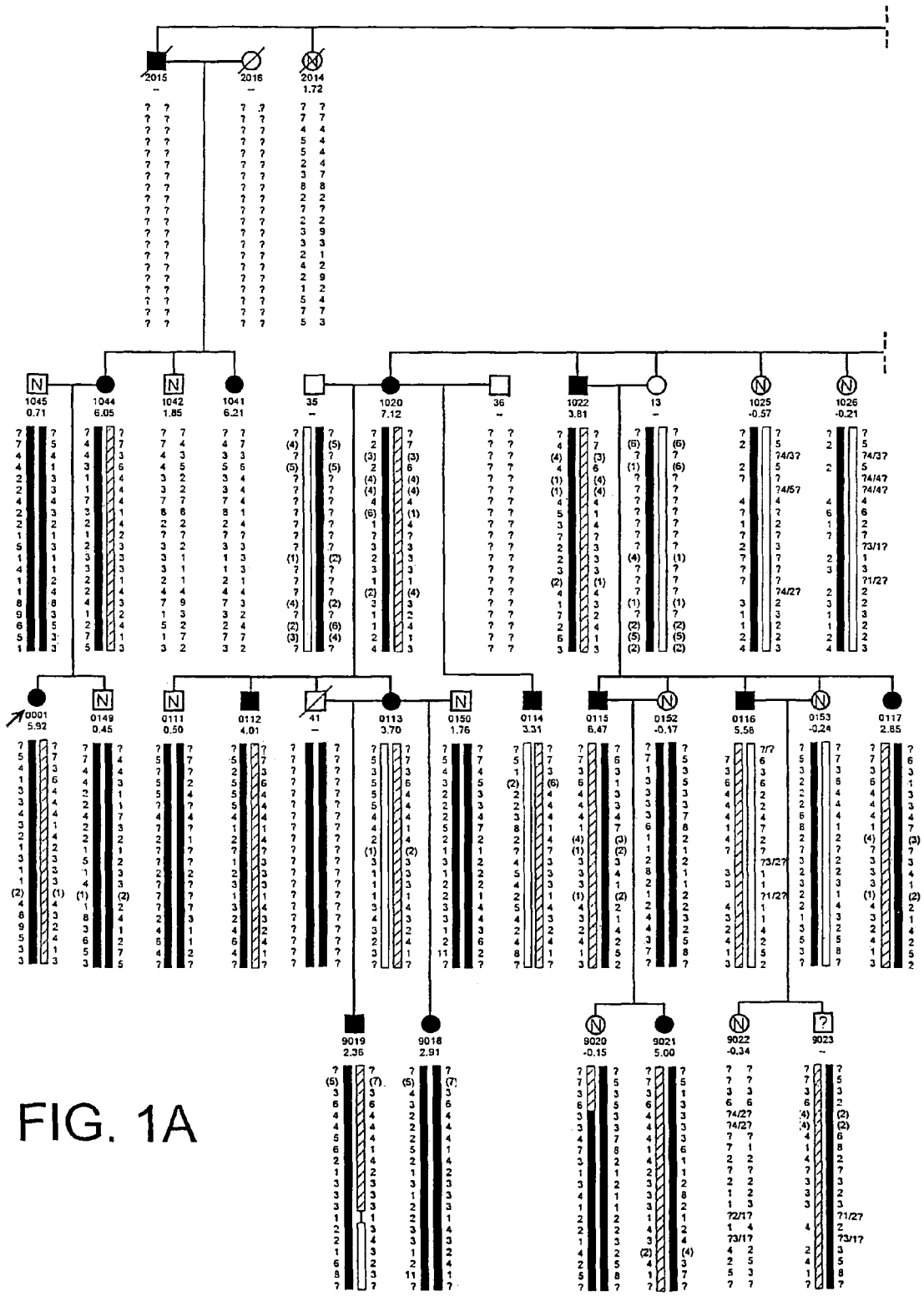
FIG. 1 shows the pedigree of the individuals used in the genetic linkage studies. Under each individual is an ID number, the z-score for spinal BMD, and the allele calls for the critical markers on chromosome 11. Solid symbols represent "affected" individuals. Symbols containing "N" are "unaffected" individuals. DNA from 37 individuals was genotyped. Question marks denote unknown genotypes or individuals who were not genotyped.

To aid in the understanding of the specification and claims, the following definitions are provided.

"Gene" refers to a DNA sequence that encodes through its template or messenger RNA a sequence of amino acids characteristic of a specific peptide. The term "gene" includes intervening, non-coding regions, as well as regulatory regions, and can include 5' and 3' ends.

By "nucleic acid" is meant to include single stranded and double stranded nucleic acids including, but not limited to DNAs, RNAs (e.g., mRNA, tRNAs, siRNAs), cDNAs, recombinant DNA (rDNA), rRNAs, antisense nucleic acids, oligonucleotides, and oligomers, and polynucleotides. The term may also include hybrids such as triple stranded regions of RNA and/or DNA or double stranded RNA:DNA hybrids. The term also is contemplated to include modified nucleic acids such as, but not limited to biotinylated nucleic acids, tritylated nucleic acids, fluorophor labeled nucleic acids, inosine, and the like.

"Gene sequence" refers to a nucleic acid molecule, including DNA which contains a non-transcribed or non-translated sequence, which comprises a gene. The term is also intended to include any combination of gene(s), gene fragment(s), non-transcribed sequence(s) or non-translated sequence(s) which are present on the same DNA molecule.

The nucleic acid sequences of the present invention may be derived from a variety of sources including DNA, cDNA, synthetic DNA, synthetic RNA or combinations thereof. Such sequences may comprise genomic DNA which may or may not include naturally occurring introns. Moreover, such genomic DNA may be obtained in association with promoter regions and/or poly (A) sequences. The sequences, genomic DNA or cDNA may be obtained in any of several ways. Genomic DNA can be extracted and purified from suitable cells by means well known in the art. Alternatively, mRNA can be isolated from a cell and used to produce cDNA by reverse transcription or other means.

"cDNA" refers to complementary or copy DNA produced from an RNA template by the action of RNA-dependent DNA polymerase (reverse transcriptase). Thus, a "cDNA clone" means a duplex DNA sequence for which one strand is complementary to an RNA molecule of interest, carried in a cloning vector or PCR amplified. cDNA can also be single stranded after first strand synthesis by reverse transcriptase. In this form, it is a useful PCR template and does not need to be carried in a cloning vector. This term includes genes from which the intervening sequences have been removed. Thus, the term "gene", as sometimes used generically, can also include nucleic acid molecules comprising cDNA and cDNA clones.

"Recombinant DNA" means a molecule that has been engineered by splicing in vitro a cDNA or genomic DNA sequence or altering a sequence by methods such as PCR mutagenesis.

"Cloning" refers to the use of in vitro recombination techniques to insert a particular gene or other DNA sequence into a vector molecule. In order to successfully clone a desired gene, it is necessary to use methods for generating DNA fragments, for joining the fragments to vector molecules, for introducing the composite DNA molecule into a host cell in which it can replicate, and for selecting the clone having the target gene from amongst the recipient host cells.

"cDNA library" refers to a collection of recombinant DNA molecules containing cDNA inserts which together comprise the entire or a partial repertoire of genes expressed in a particular tissue or cell source. Such a cDNA library can be prepared by methods known to one skilled in the art and described by, for example, Cowell and Austin, "cDNA Library Protocols," *Methods in Molecular Biology* (1997).

"Cloning vehicle" refers to a plasmid or phage DNA or other DNA sequence which is able to replicate in a host cell. This term can also include artificial chromosomes such as BACs and YACs. The cloning vehicle is characterized by one or more endonuclease recognition sites at which such DNA sequences may be cut in a determinable fashion without loss of an essential biological function of the DNA, which may contain a marker suitable for use in the identification of transformed cells.

"Expression" refers to the process comprising transcription of a gene sequence and subsequent processing steps, such as translation of a resultant mRNA to produce the final end product of a gene. The end product may be a protein (such as an enzyme or receptor) or a nucleic acid (such as a tRNA, antisense RNA, or other regulatory factor). The term "expression control sequence" refers to a sequence of nucleotides that control or regulate expression of structural genes when operably linked to those genes. These include, for example, the lac systems, the trp system, major operator and promoter regions of the phage lambda, the control region of fd coat protein and other sequences known to control the expression of genes in prokaryotic or eukaryotic cells. Expression control sequences will vary depending on whether the vector is designed to express the operably linked gene in a prokaryotic or eukaryotic host, and may contain transcriptional elements such as enhancer elements, termination sequences, tissue-specificity elements and/or translational initiation and termination sites.

"Expression vehicle" refers to a vehicle or vector similar to a cloning vehicle but which is capable of expressing a gene which has been cloned into it, after transformation into a host. The cloned gene is usually placed under the control of (i.e., operably linked to) an expression control sequence.

"Operator" refers to a DNA sequence capable of interacting with the specific repressor, thereby controlling the transcription of adjacent gene(s).

"Promoter" refers to a DNA sequence that can be recognized by an RNA polymerase. The presence of such a sequence permits the RNA polymerase to bind and initiate transcription of operably linked gene sequences.

"Promoter region" is intended to include the promoter as well as other gene sequences which may be necessary for the initiation of transcription. The presence of a promoter region is sufficient to cause the expression of an operably linked gene sequence. The term "promoter" is sometimes used in the art to generically indicate a promoter region. Many different promoters are known in the art which direct expression of a gene in a certain cell types. Tissue-specific promoters can comprise nucleic acid sequences which cause a greater (or decreased) level of expression in cells of a certain tissue type.

"Operably linked" means that the promoter controls the initiation of expression of the gene. A promoter is operably linked to a sequence of proximal DNA if upon introduction into a host cell the promoter determines the transcription of the proximal DNA sequence(s) into one or more species of RNA. A promoter is operably linked to a DNA sequence if the promoter is capable of initiating transcription of that DNA sequence.

"Prokaryote" refers to all organisms without a true nucleus, including bacteria.

"Eukaryote" refers to organisms and cells that have a true nucleus, including mammalian cells.

"Host" includes prokaryotes and eukaryotes, such as yeast and filamentous fungi, as well as plant and animal cells. The term includes an organism or cell that is the recipient of a replicable expression vehicle.

The term "animal" is used herein to include all vertebrate animals, except humans. It also includes an individual animal in all stages of development, including embryonic and fetal stages. Preferred animals include higher eukaryotes such as avians, rodents (e.g., nice, rabbits, rats, chinchillas, guinea pigs, hamsters and the like), and mammals. Preferred mammals include bovine, equine, feline, canine, ovine, caprine, porcine, buffalo, humans, and primates.

A "transgenic animal" is an animal containing one or more cells bearing genetic information received, directly or indirectly, by deliberate genetic manipulation or by inheritance from a manipulated progenitor at a subcellular level, such as by microinjection or infection with a recombinant viral vector (e.g., adenovirus, retrovirus, herpes virus, adeno-associated virus, lentivirus). This introduced DNA molecule may be integrated within a chromosome, or it may be extra-chromosomally replicating DNA.

"Embryonic stem cells" or "ES cells" as used herein are cells or cell lines usually derived from embryos which are pluripotent meaning that they are un-differentiated cells. These cells are also capable of incorporating exogenous DNA by homologous recombination and subsequently developing into any tissue in the body when incorporated into a host embryo. It is possible to isolate pluripotent cells from sources other than embryonic tissue by methods which are well understood in the art.

Embryonic stem cells in mice have enabled researchers to select for transgenic cells and perform gene targeting. This allows more genetic engineering than is possible with other transgenic techniques. For example, mouse ES cells are relatively easy to grow as colonies in vitro. The cells can be transfected by standard procedures and transgenic cells clonally selected by antibiotic resistance. See, for example, Doetschman et al., 1994, *Gene transfer in embryonic stem cells*. In Pinkert (Ed.) *Transgenic Animal Technology: A Laboratory Handbook*. Academic Press Inc., New York, pp. 115-146. Furthermore, the efficiency of this process is such that sufficient transgenic colonies (hundreds to thousands) can be produced to allow a second selection for homologous recombinants. Mouse ES cells can then be combined with a normal host embryo and, because they retain their potency, can develop into all the tissues in the resulting chimeric animal, including the germ cells. The transgenic modification can then be transmitted to subsequent generations.

Methods for deriving embryonic stem (ES) cell lines in vitro from early preimplantation mouse embryos are well known. See for example, Evans et al., 1981 *Nature* 29: 154-6 and Martin, 1981, *Proc. Nat. Acad. Sci. USA*, 78: 7634-8. ES cells can be passaged in an undifferentiated state, provided that a feeder layer of fibroblast cells or a differentiation inhibiting source is present.

The term "somatic cell" indicates any animal or human cell which is not a sperm or egg cell or is capable of becoming a sperm or egg cell. The term "germ cell" or "germ-line cell" refers to any cell which is either a sperm or egg cell or is capable of developing into a sperm or egg cell and can therefore pass its genetic information to offspring. The term "germ cell-line transgenic animal" refers to a transgenic animal in which the genetic information was incorporated in a germ line cell, thereby conferring the ability to transfer the information to offspring. If such offspring in fact possess some or all of that information, then they, too, are transgenic animals.

The genetic alteration of genetic information may be foreign to the species of animal to which the recipient belongs, or foreign only to the particular individual recipient. In the last case, the altered or introduced gene may be expressed differently than the native gene.

"Fragment" of a gene refers to any portion of a gene sequence. A "biologically active fragment" refers to any portion of the gene that retains at least one biological activity of that gene. For example, the fragment can perhaps hybridize to its cognate sequence or is capable of being translated into a polypeptide fragment encoded by the gene from which it is derived.

"Variant" refers to a gene that is substantially similar in structure and biological activity or immunological characteristics to either the entire gene or to a fragment of the gene. Provided that the two genes possess a similar activity, they are considered variant as that term is used herein even if the sequence of encoded amino acid residues is not identical. Preferentially, as used herein (unless otherwise defined) the variant is one of LRP5, HBM or LRP6. The variant preferably is one that yields an HBM-like phenotype (i.e., enhances bones mass and/or modulates lipid levels). These variants include missense mutations, single nucleotide polymorphisms (SNPs), mutations which result in changes in the amino acid sequence of the protein encoded by the gene or nucleic acid, and combinations thereof, as well as corn in the exon domains of the HBM gene and mutations in LRP5 or LRP6 which result in an HBM like phenotype.

"Amplification of nucleic acids" refers to methods such as polymerase chain reaction (PCR), ligation amplification (or ligase chain reaction, LCR) and amplification methods based on the use of Q-beta replicase. These methods are well known in the art and described, for example, in U.S. Pat. Nos. 4,683,195 and 4,683,202. Reagents and hardware for conducting PCR are commercially available. Primers useful for amplifying sequences from the HBM region are preferably complementary to, and hybridize specifically to sequences in the HBM region or in regions that flank a target region therein. HBM sequences generated by amplification may be sequenced directly. Alternatively, the amplified sequence(s) may be cloned prior to sequence analysis.

"Antibodies" may refer to polyclonal and/or monoclonal antibodies and fragments thereof, and immunologic binding equivalents thereof, that can bind to the HBM proteins and fragments thereof or to nucleic acid sequences from the HBM region, particularly from the HBM locus or a portion thereof. Preferred antibodies also include those capable of binding to LRP5, LRP6 and HBM variants. The term antibody is used both to refer to a homogeneous molecular entity, or a mixture such as a serum product made up of a plurality of different molecular entities. Proteins may be prepared synthetically in a protein synthesizer and coupled to a carrier molecule and injected over several months into rabbits. Rabbit sera is tested for immunoreactivity to the HBM protein or fragment. Monoclonal antibodies may be made by injecting mice with the proteins, or fragments thereof. Monoclonal antibodies will be screened by ELISA and tested for specific immunoreactivity with HBM protein or fragments thereof Harlow et al., *Antibodies: A Laboratory Manual*, Cold Spring Harbor Laboratory, Cold Spring Harbor, N.Y. (1988) and *Using Antibodies: A Laboratory Manual*, Harlow, Ed and Lane, David (Cold Spring Harbor Press, 1999). These antibodies will be useful in assays as well as pharmaceuticals. By "antibody" is meant to include but not limited to polyclonal, monoclonal, chimeric, human, humanized, bispecific, multispecific, primatized™ antibodies.

"HBM protein" refers to a protein that is identical to a Zmax1 (LRP5) protein except that it contains an alteration of glycine 171 to a valine. An HBM protein is defined for any organism that encodes a Zmax1 (LRP5) true homolog. For example, a mouse HBM protein refers to the mouse Zmax1 (LRP5) protein having the glycine 170 to valine substitution.

By "HBM-like" is meant a variant of LRP5, LRP6 or HBM which when expressed in a cell is capable of modulating bone mass, lipid levels, Dkk activity, and/or Wnt activity.

In one embodiment of the present invention, "HBM gene" refers to the genomic DNA sequence found in individuals showing the HBM characteristic or phenotype, where the sequence encodes the protein indicated by SEQ ID NO: 4. The HBM gene and the Zmax1 (LRP5) gene are allelic. The protein encoded by the HBM gene has the property of causing elevated bone mass, while the protein encoded by the Zmax1 (LRP5) gene does not. The HBM gene and the Zmax1 (LRP5) gene differ in that the HBM gene has a thymine at position 582, while the Zmax1 gene has a guanine at position 582. The HBM gene comprises the nucleic acid sequence shown as SEQ ID NO: 2. The HBM gene may also be referred to as an "HBM polymorphism." Other HBM genes may further have silent mutations, such as those discussed in Section 3 below.

In alternative embodiments of the present invention, "HBM gene" may also refer to any allelic variant of Zmax1 (LRP5) or LRP6 which results in the HBM phenotype. Such variants may include alteration from the wild-type protein coding sequence as described herein and/or alteration in expression control sequences of Zmax1 (LRP5) or contains an amino acid mutation in LRP5 or LRP6, such that the resulting protein produces a phenotype which enhances bone mass and/or modulates lipid levels. A preferred example of such a variant is an alteration of the endogenous Zmax1 (LRP5) promoter region resulting in increased expression of the Zmax1 (LRP5) protein.

"Normal," "wild-type," "unaffected", "Zmax1", "Zmax", "LR3" and "LRP5" all refer to the genomic DNA sequence that encodes the protein indicated by SEQ ID NO: 3. LRP5 has also been referred to LRP7 in mouse. Zmax1, LRP5 and Zmax may be used interchangeably throughout the specification and are meant to be the same gene, perhaps only relating to the gene in a different organism. The Zmax1 gene has a guanine at position 582 in the human sequence. The Zmax1 gene of human comprises the nucleic acid sequence shown as SEQ ID NO: 1. "Normal," "wild-type," "unaffected", "Zmax1" and "LRP5" also refer to allelic variants of the genomic sequence that encodes proteins that do not contribute to elevated bone mass. The Zmax1 (LRP5) gene is common in the human population, while the HBM gene is rare.

"5YWTD+EGF" refers to a repeat unit found in the Zmax1 (LRP5) protein, consisting of five YWTD repeats followed by an EGF repeat (5YWTD disclosed as SEQ ID NO: 1088).

"Bone development" generally refers to any process involved in the change of bone over time, including, for example, normal development, changes that occur during disease states, and changes that occur during aging. This may refer to structural changes in and dynamic rate changes such as growth rates, resorption rates, bone repair rates, and etc. "Bone development disorder" particularly refers to any disorders in bone development including, for example, changes that occur during disease states and changes that occur during aging. Bone development may be progressive or cyclical in nature. Aspects of bone that may change during development include, for example, mineralization, formation of specific anatomical features, and relative or absolute numbers of various cell types.

"Bone modulation" or "modulation of bone formation" refers to the ability to affect any of the physiological processes involved in bone remodeling, as will be appreciated by one skilled in the art, including, for example, bone resorption and appositional bone growth, by, inter alia, osteoclastic and osteoblastic activity, and may comprise some or all of bone formation and development as used herein.

Bone is a dynamic tissue that is continually adapting and renewing itself through the removal of old or unnecessary bone by osteoblastic and the rebuilding of new bone by osteoblasts. The nature of the coupling between these processes is responsible both for the modeling of bone during growth as well as the maintenance of adult skeletal integrity through remodeling and repair to meet the everyday needs of mechanical usage. There are a number of diseases of bone that result from an uncoupling of the balance between bone resorption and formation. With aging there is a gradual "physiologic" imbalance in bone turnover, which is particularly exacerbated in women due to menopausal loss of estrogen support, that leads to a progressive loss of bone. The reduction in bone mass and deterioration in bone architecture results in an increase in bone fragility and susceptibility to spontaneous fractures. For every 10 percent of bone that is lost the risk of fracture doubles. Individuals with bone mineral density (BMD) in the spine or proximal femur 2.5 or more standard deviations below normal peak bone mass are classified as osteoporotic. However, osteopenic individuals with BMD between 1 and 2.5 standard deviations below the norm are clearly at risk of suffering bone loss related disorders.

Bone modulation may be assessed by measuring parameters such as bone mineral density (BMD) and bone mineral content (BMC) by pDXA X-ray methods, bone size, thickness or volume as measured by X-ray, bone formation rates as measured for example by calcien labeling, total, trabecular, and mid-shaft density as measured by pQCT and/or mCT methods, connectivity and other histological parameters as measured by mCT methods, mechanical bending and compressive strengths as preferably measured in femur and vertebrae respectively. Due to the nature of these measurements, each may be more or less appropriate for a given situation as the skilled practitioner will appreciate. Furthermore, parameters and methodologies such as a clinical history of freedom from fracture, bone shape, bone morphology, connectivity, normal histology, fracture repair rates, and other bone quality parameters are known and used in the art. Most preferably, bone quality may be assessed by the compressive strength of vertebra when such a measurement is appropriate. Bone modulation may also be assessed by rates of change in the various parameters. Most preferably, bone modulation is assessed at more than one age.

"Normal bone density" refers to a bone density within two standard deviations of a Z score of 0 in the context of the HBM linkage study. In a general context, the range of normal bone density parameters is determined by routine statistical methods. A normal parameter is within about 1 or 2 standard deviations of the age and sex normalized parameter, preferably about 2 standard deviations. A statistical measure of meaningfulness is the P value which can represent the likelihood that the associated measurement is significantly different from the mean. Significant P values are P<0.05, 0.01, 0.005, and 0.001, preferably at least P<0.01.

"HBM" refers to "high bone mass" although this term may also be expressed in terms of bone density, mineral content, and size.

The "HBM phenotype" and "HBM-like phenotype" may be characterized by an increase of about 2 or more standard deviations, preferably 2, 2.5, 3, or more standard deviations in 1, 2, 3, 4, 5, or more quantitative parameters of bone modulation, preferably bone-density and mineral content and bone strength parameters, above the age and sex norm for that parameter. The HBM phenotype and HBM-like phenotype are characterized by statistically significant increases in at least one parameter, preferably at least 2 parameters, and more preferably at least 3 or more parameters. The HBM phenotype and the HBM-like phenotype may also be characterized by an increase in one or more bone quality parameters and most preferably increasing parameters are not accompanied by a decrease in any bone quality parameters. Most preferably, an increase in bone modulation parameters and/or bone quality measurements is observed at more than one age. The HBM phenotype and HBM-like phenotype also includes changes of lipid levels, Wnt activity and/or Dkk activity.

A "Zmax1 system" or "LRP5 system" refers to a purified protein, cell extract, cell, animal, human or any other composition of matter in which Zmax1 (LRP5) is present in a normal or mutant form.

The terms "isolated" and "purified" refer to a substance altered by hand of man from the natural environment. An isolated peptide may be for example in a substantially pure form or otherwise displaced from its native environment such as by expression in an isolated cell line or transgenic animal. An isolated sequence may for example be a molecule in substantially pure form or displaced from its native environment such that at least one end of said isolated sequence is not contiguous with the sequence it would be contiguous with in nature.

A "surrogate marker" refers to a diagnostic indication, symptom, sign or other feature that can be observed in a cell, tissue, human or animal that is correlated with the HBM gene or elevated bone mass or both, but that is easier to measure than bone density. The general concept of a surrogate marker is well accepted in diagnostic medicine.

The present invention encompasses the Zmax1 (LRP5) gene and Zmax1 (LRP5) protein in the forms indicated by SEQ ID NOS: 1 and 3, respectively, and other closely related variants, as well as the adjacent chromosomal regions of Zmax1 (LRP5) necessary for its accurate expression. In a preferred embodiment, the present invention is directed to at least 15 contiguous nucleotides of the nucleic acid sequence of SEQ ED NO: 1.

The present invention further encompasses variants of the LRP6 gene and its corresponding protein which result in an enhanced bone mass and/or modulate lipids and/or modulate the Wnt signaling pathway.

"Biologically active" refers to those forms of proteins and polypeptides, including conservatively substituted variants, alleles of genes encoding a protein or polypeptide fragments of proteins which retain a biological and/or immunological activity of the wild-type protein or polypeptide. Preferably the activity is one which induces a change in LRP5, LRP6, or Dkk activity, such as inhibiting the interaction of LRP5 or LRP6 or variants thereof with Dkk, or Dkk with another ligand binding partner (e.g., Dkk-1 with a Dkk-1 interacting protein such as those shown in FIG. 31). By biologically active is also meant to include any form which modulates Wnt signaling.

By "modulate" and "regulate" is meant methods, conditions, or agents which increase or decrease the wild-type activity of an enzyme, inhibitor, signal transducer, receptor, transcription activator, co-factor, and the like. This change in activity can be an increase or decrease of mRNA translation, mRNA or DNA transcription, and/or mRNA or protein degradation, which may in turn correspond to an increase or decrease in biological activity.

By "modulated activity" and "regulated activity" is meant any activity, condition, disease or phenotype which is modulated by a biologically active form of a protein. Modulation may be effected by affecting the concentration or subcellular localization of biologically active protein, i.e., by regulating expression or degradation, or by direct agonistic or antagonistic effect as, for example, through inhibition, activation, binding, or release of substrate, modification either chemically or structurally, or by direct or indirect interaction which may involve additional factors.

By "effective amount" or "dose effective amount" or "therapeutically effective amount" is meant an amount of an agent which modulates a biological activity of the polypeptide of the invention.

By "immunologically active" is meant any immunoglobulin protein or fragment thereof which recognizes and binds to an antigen.

By "Dkk" is meant to refer to the nucleic acids and proteins of members of the Dkk (Dickkopf) family. This includes, but is not limited to, Dkk-1, Dkk-2, Dkk-3, Dkk-4, Soggy, and related Dkk proteins. Dkk-1 is a preferred embodiment of the present invention. However, the Dkk proteins have substantial homology and one skilled in the art will appreciate that all of the embodiments of the present invention utilizing Dkk-1 may also be utilized with the other Dkk proteins.

By "Dkk-1" is meant to refer to the Dkk-1 protein and nucleic acids which encode the Dkk-1 protein. Dkk-1 refers to Dickkopf-1, and in *Xenopus* it is related to at least Dkk-2, Dkk-3, and Dkk-4 (see Krupnik et al., 1999 *Gene* 238: 301-313). Dkk-1 was first identified in *Xenopus* (Glinka et al., 1998 *Nature* 391: 357-62). It was recognized as a factor capable of inducing ectopic head formation in the presence of inhibition of the BMP pathway. It was then also found to inhibit the axis-inducing activity of several *Xenopus* Wnt molecules by acting as an extracellular antagonist of Wnt signaling. Mammalian homologs have been found including Dkk-1, Dkk-2, Dkk-3, Dkk-4 and soggy (Fedi et al., 1999 *J. Biol. Chem.* 274: 19465-72; and Krupnick et al. 1999). Human Dkk-1 was also referred to as sk (Fedi et al. 1999). As used herein, Dkk-1 is meant to include proteins from any species having a Wnt pathway in which Dkk-1 interacts. Particularly preferred are mammalian species (e.g., murine, caprine, canine, bovine, feline, equine, primate, ovine, porcine and the like), with particularly preferred mammals being humans. Nucleic acid sequences encoding Dkk-1 include, but are not limited to human Dkk-1 (GenBank Accession Nos. AH009834, XM_005730, AF261158, AF261157, AF177394, AF127563 and NM_012242), *Mus musculus* dickkopf homolog 1 (GenBank Accession No. NM_010051), and *Danio rerio* dickkopf-1 (GenBank Accession Nos. AF116852 and AB023488). The genomic sequences with exon annotation are GenBank Accession Nos. AF261157 and AF261158. Also contemplated are homologs of these sequences which have Dkk-1 activity in the Wnt pathway. Dkk-1 amino acid sequences include, but are not limited to human dickkopf homolog 1 (GenBank Accession Nos. AAG15544, BAA34651, NP_036374, AAF02674, AAD21087, and XP_005730), *Danio rerio* (zebrafish) dickkopf1 (GenBank Accession Nos. BAA82135 and AAD22461) and murine dickkopf-1 (GenBank Accession Nos. O54908 and NP_034181). Variants and homologs of these sequences which possess Dkk-1 activity are also included when referring to Dkk-1.

By "LRP5 mediated", "LRP6 mediated", and "Dkk mediated" disorder, condition or disease is any abnormal state that involves LRP5, LRP6 and/or Dkk activity. The abnormal state can be induced by environmental exposure or drug administration. Alternatively, the disease or disorder can be due to a genetic defect. Dkk mediated diseases, disorders and conditions include but are not limited to bone mass disorders or conditions and lipid disorders and conditions. For example, bone mass disorders/conditions/diseases, which may be mediated by Dkk, LRP5 and/or LRP6 include but are not limited to age related loss of bone, bone fractures (e.g., hip fracture, Colle's fracture, vertebral crush fractures), chondrodystrophies, drug-induced disorders (e.g., osteoporosis due to administration of glucocorticoids or heparin and osteomalacia due to administration of aluminum hydroxide, anticonvulsants, or glutethimide), high bone turnover, hypercalcemia, hyperostosis, osteoarthritis, osteogenesis imperfecta, osteomalacia, osteomyelitis, osteoporosis, Paget's disease, and rickets.

Lipid disorders/diseases/conditions, which may be mediated by Dkk, LRP5, and/or LRP6 include but are not limited to familial lipoprotein lipase deficiency, familial apoprotein CII deficiency, familial type 3 hyperlipoproteinemia, familial hypercholesterolemia, familial hypertriglyceridemia, multiple lipoprotein-type hyperlipidemia, elevated lipid levels due to dialysis and/or diabetes, and elevated lipid levels of unknown etiologies The term "recognizes and binds," when used to define interactions of antisense nucleotides or siRNA's (small inhibitory RNA) with a target sequence, means that a particular antisense or small inhibitory RNA (siRNA) sequence is substantially complementary to the target sequence, and thus will specifically bind to a portion of an mRNA encoding polypeptide. As such, typically the sequences will be highly complementary to the mRNA target sequence, and will have no more than 1, 2, 3, 4, 5, 6, 7, 8, 9, or 10 base mismatches throughout the sequence. In many instances, it may be desirable for the sequences to be exact matches, i.e. be completely complementary to the sequence to which the oligonucleotide specifically binds, and therefore have zero mismatches along the complementary stretch. As such, highly complementary sequences will typically bind quite specifically to the target sequence region of the mRNA and will therefore be highly efficient in reducing, and/or even inhibiting the translation of the target mRNA sequence into polypeptide product.

Substantially complementary oligonucleotide sequences will be greater than about 80 percent complementary (or '% exact-match') to the corresponding MnRNA target sequence to which the oligonucleotide specifically binds, and will, more preferably be greater than about 85 percent complementary to the corresponding mRNA target sequence to which the oligonucleotide specifically binds. In certain aspects, as described above, it will be desirable to have even more substantially complementary oligonucleotide sequences for use in the practice of the invention, and in such instances, the oligonucleotide sequences will be greater than about 90 percent complementary to the corresponding mRNA target sequence to which the oligonucleotide specifically binds, and may in certain embodiments be greater than about 95 percent complementary to the corresponding mRNA target sequence to which the oligonucleotide specifically binds, and even up to and including 96%, 97%, 98%, 99%, and even 100% exact match complementary to the target mRNA to which the designed oligonucleotide specifically binds.

Percent similarity or percent complementary of any of the disclosed sequences may be determined, for example, by comparing sequence information using the GAP computer program, version 6.0, available from the University of Wisconsin Genetics Computer Group (UWGCG). The GAP program utilizes the alignment method of Needleman and Wunsch (1970). Briefly, the GAP program defines similarity as the number of aligned symbols (i.e., nucleotides or amino acids) which are similar, divided by the total number of symbols in the shorter of the two sequences. The preferred default parameters for the GAP program include: (1) a unary comparison matrix (containing a value of 1 for identities and 0 for non-identities) for nucleotides, and the weighted comparison matrix of Gribskov and Burgess (1986), (2) a penalty of 3.0 for each gap and an additional 0.10 penalty for each symbol in each gap; and (3) no penalty for end gaps.

By "mimetic" is meant a compound or molecule that performs the same function or behaves similarly to the compound mimicked.

By "reporter element" is meant a polynucleotide that encodes a polypeptide capable of being detected in a screening assays. Examples of polypeptides encoded by reporter elements include, but are not limited to, lacZ, GFP, luciferase, and chloramphenicol acetyltransferase.

2. Introduction

The present invention also encompasses the HBM gene and HBM protein ill the forms indicated by SEQ ID NO: 2 and 4, respectively, and other closely related variants, as well as the adjacent chromosomal regions of the HBM gene necessary for its accurate expression. In a preferred embodiment, the present invention is directed to at least 15 contiguous nucleotides of the nucleic acid sequence of SEQ ID NO: 2. More preferably, the present invention is directed to at least 15 contiguous nucleotides of the nucleic acid sequence of SEQ ID NO: 2, wherein one of the 15 contiguous nucleotides is the thymine at nucleotide 582.

The invention also relates to the nucleotide sequence of the Zmax1 (LRP5) gene region, as well as the nucleotide sequence of the HBM region. More particularly, a preferred embodiment are the BAC clones containing segments of the Zmax1 (LRP5) gene region B200E21-H and B527D 12-H. A preferred embodiment is the nucleotide sequence of the BAC clones consisting of SEQ ID NOS: 5-11.

The invention also concerns the use of the nucleotide sequence to identify DNA probes for the Zmax1 (LRP5) gene and the HBM gene, PCR primers to amplify the Zmax1 (LRP5) gene and the HBM gene, nucleotide polymorphisms in the Zmax1 (LRP5) gene and the HBM gene, and regulatory elements of the Zmax1 (LRP5) gene and the HBM gene.

This invention describes the further localization of the chromosomal location of the Zmax1 (LRP5) gene and HBM gene on chromosome 11q13.3, between genetic markers D11S987 and SNP_CONTIG033-6, as well as the DNA sequences of the Zmax1 (LRP5) gene and the HBM gene. The chromosomal location was refined by the addition of more genetic markers to the mapping panel used to map the gene, and by the extension of the pedigree to include more individuals. The pedigree extension was critical because the new individuals that have been genotyped harbor critical recombination events that narrow the region. To identify genes in the region on 11q13.3, a set of BAC clones containing this chromosomal region was identified. The BAC clones served as a template for genomic DNA sequencing, and also as a reagent for identifying coding sequences by direct cDNA selection. Genomic sequencing and direct cDNA selection were used to characterize more than 1.5 million base pairs of DNA from 11q13.3. The Zmax1 (LRP5) gene was identified within this region and the HBM gene was then discovered after mutational analysis of affected and unaffected individuals.

When a gene has been genetically localized to a specific chromosomal region, the genes in this region can be characterized at the molecular level by a series of steps that include: cloning of the entire region of DNA in a set of overlapping clones (physical mapping), characterization of genes encoded by these clones by a combination of direct cDNA selection, exon trapping and DNA sequencing (gene identification), and identification of mutations in these genes by comparative DNA sequencing of affected and unaffected members of the HBM kindred (mutation analysis).

Physical mapping is accomplished by screening libraries of human DNA cloned in vectors that are propagated in E. coli or S. cereviseae using PCR assays designed to amplify unique molecular landmarks in the chromosomal region of interest. To generate a physical map of the HBM candidate region, a library of human DNA cloned in Bacterial Artificial Chromosomes (BACs) was screened with a set of Sequence Tagged Site (STS) markers that had been previously mapped to chromosome 11q12-q13 by the efforts of the Human Genome Project.

STSs are unique molecular landmarks in the human genome that can be assayed by PCR. Through the combined efforts of the Human Genome Project, the location of thousands of STSs on the twenty-two autosomes and two sex chromosomes has been determined. For a positional cloning effort, the physical map is tied to the genetic map because the markers used for genetic mapping can also be used as STSs for physical mapping. By screening a BAC library with a combination of STSs derived from genetic markers, genes, and random DNA fragments, a physical map comprised of overlapping clones representing all of the DNA in a chromosomal region of interest can be assembled.

BACs are cloning vectors for large (80 kilobase to 200 kilobase) segments of human or other DNA that are propagated in E. coli. To construct a physical map using BACs, a library of BAC clones is screened so that individual clones harboring the DNA sequence corresponding to a given STS or set of STSs are identified. Throughout most of the human genome, the STS markers are spaced approximately 20 to 50 kilobases apart, so that an individual BAC clone typically contains at least two STS markers. In addition, the BAC libraries that were screened contain enough cloned DNA to cover the human genome six times over. Therefore, an individual STS typically identifies more than one BAC clone. By screening a six-fold coverage BAC library with a series of STS markers spaced approximately 50 kilobases apart, a physical map consisting of a series of overlapping BAC clones, i.e. BAC contigs, can be assembled for any region of the human genome. This map is closely tied to the genetic map because many of the STS markers used to prepare the physical map are also genetic markers.

When constructing a physical map, it often happens that there are gaps in the STS map of the genome that result in the inability to identify BAC clones that are overlapping in a given location. Typically, the physical map is first constructed from a set of STSs that have been identified through the publicly available literature and World Wide Web resources. The initial map consists of several separate BAC contigs that are separated by gaps of unknown molecular distance. To identify BAC clones that fill these gaps, it is necessary to develop new STS markers from the ends of the clones on either side of the gap. This is done by sequencing the terminal 200 to 300 base pairs of the BACs flanking the gap, and developing a PCR assay to amplify a sequence of 100 or more base pairs. If the terminal sequences are demonstrated to be unique within the human genome, then the new STS can be used to screen the BAC library to identify additional BACs that contain the DNA from the gap in the physical map. To assemble a BAC contig that covers a region the size of the HBM candidate region (2,000,000 or more base pairs), it is often necessary to develop new STS markers from the ends of several clones.

After building a BAC contig, this set of overlapping clones serves as a template for identifying the genes encoded in the chromosomal region. Gene identification can be accomplished by many methods. Three methods are commonly used: (1) a set of BACs selected from the BAC contig to represent the entire chromosomal region can be sequenced, and computational methods can be used to identify all of the genes, (2) the BACs from the BAC contig can be used as a reagent to clone cDNAs corresponding to the genes encoded in the region by a method termed direct cDNA selection, or (3) the BACs from the BAC contig can be used to identify coding sequences by selecting for specific DNA sequence motifs in a procedure called exon trapping. The present invention includes genes identified by the first two methods.

To sequence the entire BAC contig representing the HBM candidate region, a set of BACs was chosen for subcloning into plasmid vectors and subsequent DNA sequencing of these subclones. Since the DNA cloned in the BACs represents genomic DNA, this sequencing is referred to as genomic sequencing to distinguish it from cDNA sequencing. To initiate the genomic sequencing for a chromosomal region of interest, several non-overlapping BAC clones are chosen. DNA for each BAC clone is prepared, and the clones are sheared into random small fragments which are subsequently cloned into standard plasmid vectors such as pUC18. The plasmid clones are then grown to propagate the smaller fragments, and these are the templates for sequencing. To ensure adequate coverage and sequence quality for the BAC DNA sequence, sufficient plasmid clones are sequenced to yield six-fold coverage of the BAC clone. For example, if the BAC is 100 kilobases long, then phagemids are sequenced to yield 600 kilobases of sequence. Since the BAC DNA was randomly sheared prior to cloning in the phagemid vector, the 600 kilobases of raw DNA sequence can be assembled by computational methods into overlapping DNA sequences termed sequence contigs. For the purposes of initial gene identification by computational methods, six-fold coverage of each BAC is sufficient to yield ten to twenty sequence contigs of 1000 base pairs to 20,000 base pairs.

The sequencing strategy employed in this invention was to initially sequence "seed" BACs from the BAC contig in the HBM candidate region. The sequence of the "seed" BACs was then used to identify minimally overlapping BACs from the contig, and these were subsequently sequenced. In this manner, the entire candidate region was sequenced, with several small sequence gaps left in each BAC. This sequence served as the template for computational gene identification. One method for computational gene identification is to compare the sequence of BAC contig to publicly available databases of cDNA and genomic sequences, e.g., unigene, dbEST, GenBank. These comparisons are typically done using the BLAST family of computer algorithm's and programs (Altschul et al., *J. Mol. Biol.,* 215:403-410 (1990)). The BAC sequence can also be translated into protein sequence, and the protein sequence can be used to search publicly available protein databases, using a version of BLAST designed to analyze protein sequences (Altschul et al., 1997 *Nucl. Acids Res.* 25: 3389-3402). Another method is to use computer algorithms such as MZEF (Zhang, 1997 *Proc. Natl. Acad. Sci. USA,* 94: 565-568) and GRAIL (Uberbacher et al., 1996 *Methods Enzymol.* 266: 259-281), which predict the location of exons in the sequence based on the presence of specific DNA sequence motifs that are common to all exons, as well as the presence of codon usage typical of human protein encoding sequences.

In addition to identifying genes by computational methods, genes were also identified by direct cDNA selection (Del Mastro et al., 1995 *Genome Res.* 5(2): 185-194). In direct cDNA selection, cDNA pools from tissues of interest are prepared, and the BACs from the candidate region are used in a liquid hybridization assay to capture cDNA which basepairs to coding regions in the BAC. In the methods described herein, the cDNA pools were created from several different tissues by random priming the first strand cDNA from poly-A RNA, synthesizing the second strand cDNA by standard methods, and adding linkers to the ends of the cDNA fragments. The linkers are used to amplify the cDNA pools. The BAC clones are used as a template for in vitro DNA synthesis to create a biotin labeled copy of the BAC DNA. The biotin labeled copy of the BAC DNA is then denatured and incubated with an excess of the PCR amplified, linkered cDNA pools which have also been denatured. The BAC DNA and cDNA are allowed to anneal in solution, and heteroduplexes between the BAC and the cDNA are isolated using streptavidin coated magnetic beads. The cDNA which is captured by the BAC is then amplified using primers complimentary to the linker sequences, and the hybridization/selection process is repeated for a second round. After two rounds of direct cDNA selection, the cDNA fragments are cloned, and a library of these direct selected fragments is created.

The cDNA clones isolated by direct selection are analyzed by two methods. Since a pool of BACs from the HBM candidate region is used to provide the genomic DNA sequence, the cDNAs must be mapped to individual BACs. This is accomplished by arraying the BACs in microtiter dishes, and replicating their DNA in high density grids. Individual cDNA clones are then hybridized to the grid to confirm that they have sequence identity to an individual BAC from the set used for direct selection, and to determine the specific identity of that BAC. cDNA clones that are confirmed to correspond to individual BACs are sequenced. To determine whether the cDNA clones isolated by direct selection share sequence identity or similarity to previously identified genes, the DNA and protein coding sequences are compared to publicly available databases using the BLAST family of programs.

The combination of genomic DNA sequence and cDNA sequence provided by BAC sequencing and by direct cDNA selection yields an initial list of putative genes in the region. The genes in the region were all candidates for the HBM locus. To further characterize each gene, Northern blots were performed to determine the size of the transcript corresponding to each gene, and to determine which putative exons were transcribed together to male an individual gene. For Northern blot analysis of each gene, probes were prepared from direct selected cDNA clones or by PCR amplifying specific fragments from genomic DNA or from the BAC encoding the putative gene of interest. The Northern blots gave information on the size of the transcript and the tissues in which it was expressed. For transcripts which were not highly expressed, it was sometimes necessary to perform a reverse transcription PCR assay using RNA from the tissues of interest as a template for the reaction.

Gene identification by computational methods and by direct cDNA selection provides unique information about the genes in a region of a chromosome. When genes are identified, then it is possible to examine different individuals for mutations in each gene.

The present invention also encompasses the HBM gene and HBM protein in the forms indicated by SEQ ID NO: 2 and 4, respectively, and other closely related variants, as well as the adjacent chromosomal regions of the HBM gene necessary for its accurate expression. In a preferred embodiment, the present invention is directed to an isolated nucleic acid sequence of SEQ ID NO: 2, as well as variants thereof. Variants include changes in SEQ ID NO:1 which result in a HBM like phenotype. Examples of such variants are discussed further in Section 3 below and in the examples. These variants preferably have at least about 90%, preferably at least about 95%, or more preferably at least about 98% or more similarity or identity to the nucleic acid sequence of SEQ ID NOS: 1 or 2 or biologically active fragments thereof. Therefore, sequences which are 96%, 97%, and 99% or more siuilar to SEQ ID NOS: 1 or 2 or biologically active fragments thereof are also contemplated herein.

Determination of the degree of variation between a high bone mass (HBM) variant can be performed using BLAST or FASTA or other suitable algorithm using standard default parameters. Preferably, identity will be determined for coding regions of SEQ ID NOS: 1-2, but can also include non-coding domains. Additionally, alignment programs can be used to identify conserved sequences or potential motifs across different animal species. Alignment programs can also be used to align the nucleic acid and/or protein sequences of related genes and the proteins that they encode. Preferred alignment programs include CLUSTALW, PILEUP and GAP, and would preferably be used with default parameters. For example, such programs can be used to align the sequences of Zmax1 (LRP5), HBM, and LDL receptor-related protein 6 (LRP6) and sequences related thereto.

By a polynucleotide having a nucleotide sequence at least, for example, 90% "similar" to a reference nucleotide sequence encoding a polypeptide, is intended that the nucleotide sequence of the polynucleotide is identical to the reference sequence except that the polynucleotide sequence may include up to ten point mutations per each 100 nucleotides of the reference nucleotide sequence. These mutations of the reference sequence may occur at any location in SEQ ID NO: 1 or 2 or in the LRP6 gene. The mutations may be silent.

Another embodiment contemplates that such polynucleotide variants of SEQ ID NO: 1 or 2 comprise nucleic acid sequences which are at least 15, 20, 25, 30, 35, 40, 45, 50, 60, 70, 80, 90, 100, 150, 200, 300, 400, or 500 contiguous nucleotides of SEQ ID NO: 1 or 2. More preferably, such polynucleotide variants have a contiguous nucleic acid sequence corresponding with the polymorphism at nucleotide 582 (G→T substitution) of SEQ ID NO: 2 or other variants of SEQ ID NO: 1 or 2, which comprise a mutation which modulates bone mass and/or lipid levels when the polypeptide encoded thereby is administered to a subject. All variants of SEQ ID NO: 1 or 2 contemplated possess the characteristic of encoding a protein or polypeptide which when administered to a subject induces bone modulation. Additional variants which may be responsible for modulating bone mass when administered to a subject may lie within the domain known to contain the HBM polymorphism and which encodes the beta propeller domain (YWTD motifs) (YWTD disclosed as SEQ ID NO: 1087). Alternatively, other variants of Zmax1 (LRP5) which modulate high bone mass in a subject may be due to mutations in the nucleic acid sequences encoding any of the other conserved domains of Zmax1 (LRP5), such as those set forth in FIG. 4 (e.g., the RGD extracellular attachment site, the binding site for LDL and calcium, the cysteine rich growth factor repeats, the ideal PEST region, and the internalization domain). See Section 3 and the Examples below for additional mutations which may confer enhance bone mass and/or lipid modulation.

HBM polynucleotides and HBM like variants contemplated include those which hybridize under stringent conditions to SEQ ID NO: 2. Hybridization methods are known in the art and include, but are not limited to: (a) washing with 0.1×SSPE (0.62 M NaCl, 0.06 M NaH$_2$PO$_4$.H$_2$O, 0.075 M EDTA, pH 7.4) and 0.1% sodium dodecyl sulfate (SDS) at 50° C.; (b) washing with 50% formamide, 5×SSC (0.75 M NaCl, 0.075 M sodium citrate), 50 mM sodium phosphate (pH 6-8), 0. 1% sodium pyrophosphate, 5× Denliardt's solution, sonicated salmon sperm DNA (50 µg/ml), 0.1% SDS and 10% dextran sulfate at 42° C., followed by washing at 42° C. in 0.2×SSC and 0.1% SDS; and (c) washing with of 0.5 M NaPO$_4$, 7% SDS at 65° C. followed by washing at 60° C. in 0.5×SSC and 0.1% SDS. Additional conditions under which HBM variants can be isolated by hybridization to SEQ ID NO: 2 or nucleic acid fragments thereof can be performed by varying the hybridization temperature. High stringency hybridization conditions are those performed at about 20° C. below the melting temperature ($T_m$) of SEQ ID NO: 2 or fragments thereof. Preferred stringency is preformed at about 5-10° C. below the $T_m$ of SEQ ID NO: 2 or fragments thereof. Additional hybridization conditions can be prepared as described in Chapter 11 of Sambrook et al., *Molecular Cloning A Laboratory Manual* (1989), or as would be known to the artisan of ordinary skill.

Alternatively, mammalian libraries (e.g., equine, primate, caprine, bovine, ovine, feline, porcine, and canine) can be probed using degenerate primers and polymerase chain reaction (PCR) techniques to identify variants of SEQ ID NO: 2 or fragments thereof. Preferably primers are utilized which hybridize under stringent conditions to the open reading frame of SEQ ID NO: 2, or to non-coding portions of the sequence. More preferably, such primers hybridize to conserved domains within SEQ ID NO: 2. For example, conserved domains include those coding for the YWTD beta-propeller domains (YWTD disclosed as SEQ ID NO: 1087) or other domains, such as those listed in FIG. 4. Preferred primers are typically 15 nucleotides in length, but can vary to be at least, about 16, 17, 18, 19, 20, 21, 22, 23, 24, 25, 30, 35, 40 or 50 (and any range in between) nucleotides in length. Heterologous hybridization is to amplify the target gene or nucleic acid sequence using degenerate PCR primers. Probes for variants of SEQ ID NO: 2 and the polypeptide encoded thereby can be obtained by preparing mixed oligonucleotides of greater than 10, preferably of 15 or more, nucleotides in length representing all possible nucleotide sequences which could encode the corresponding amino acid sequences (e.g., SEQ ID NO: 4 fragments thereof). This method is clearly documented by Gould et al., 1989 *Proc. Natl. Acad. Sci. USA* 86(6): 1934-8.

Another embodiment includes nucleic acids which encode an HBM polypeptide or HBM like variant which is at least about 90% similar to SEQ ID NO: 4 and fragments thereof, and which when administered to a subject modulate bone mass in that subject. HBM variants may have a valine corresponding to position 171 of SEQ ID NO: 4 (Gly to Val substitution) or 170 of the mouse homolog, or an amino acid change elsewhere in propeller 1 or in the protein which results in enhanced bone mass and/or lipid modulation. Other preferred embodiments include high bone mass polypeptides which have at least about 10, 15, 20, 25, 30, 35, 40, 45, 50, 60, 70, 80, 90, 100, 150, 200, 250, 300, 500 or more contiguous amino acids of SEQ ID NO: 3 or 4, with a mutation in the sequence resulting in enhanced bone mass and/or modulated lipid levels. Such contemplated contiguous sequences preferably overlap with a polymorphism corresponding to high bone mass, such as valine-171 of SEQ ID NO: 4, other mutations in propeller 1 or is predicted from the model provided in the Examples. Also contemplated are the polynucleotides encoding polypeptides which are at least about 95%, 96%, 97%, 98% and 99% or more similar to SEQ ID NO: 3 or 4 and fragments thereof, wherein these polypeptide contain at least one mutation (e.g., valine-171 or like mutation).

In another embodiment, a synthetic nucleic acid encoding SEQ ID NO: 4 is contemplated wherein the nucleic acid sequence has been conservatively substituted based on the degeneracy of the code such that no amino acids are altered in SEQ ID NO: 4, but perhaps wherein the resulting synthetic polynucleotide encoding said SEQ ID NO: 4 is one that is at least, about 50% similar to SEQ ID NO: 2. Alternatively, SEQ ID NO: 4 may contain any of the silent mutations identified in Section 3 below.

By a polypeptide having an amino acid sequence of at least, for example, 95% "identity" to a reference amino acid sequence of SEQ ID NO: 3 or 4 or fragment thereof is intended that the amino acid sequence of the polypeptide is identical to the reference sequence except that the polypeptide sequence may include up to five amino acid alterations per each 100 amino acids of the reference amino acid sequence of SEQ ID NO: 3 or 4 and has an HBM like phenotype. In other words, to obtain a polypeptide having an amino acid sequence 95% identical to a reference amino acid sequence, up to 5% of the amino acid residues in the reference sequence may be deleted or substituted with another amino acid, or a number of amino acids up to 5% of the total amino acid residues in the reference sequence may be inserted into the reference sequence. These alterations of the reference sequence may occur at the amino or carboxy terminal positions of the reference amino acid sequence or anywhere between those terminal positions, interspersed either individually among residues in the reference sequence or in one or more contiguous groups within the reference sequence.

Additional HBM polypeptides and nucleic acids which encode said HBM polypeptides are contemplated wherein amino acid residues are conservatively substituted. For example, guidance concerning how to make phenotypically silent amino acid substitutions is provided in Bowie et al., "Deciphering the Message in Protein Sequences: Tolerance to Amino Acid Substitutions," *Science* 247: 1306-10 (1990), wherein the authors indicate that there are two main approaches for studying the tolerance of an amino acid sequence to change. The first method relies on the process of evolution, in which mutations are either accepted or rejected by natural selection. The second approach uses genetic engineering to introduce amino acid changes at specific positions of a cloned gene and selections or screens to identify sequences that maintain functionality. These studies have revealed that proteins are surprisingly tolerant of amino acid substitutions. The authors further indicate which amino acid changes are likely to be permissive at a certain position of the protein. Numerous phenotypic substitutions are described in Bowie et al., supra, and the references cited therein, which are herein incorporated by reference in their entirety. Preferred substitutions would be in domains which are less conserved across species, and which do not correspond to a structurally or functionally important domain (e.g., a binding site, catalytic site, or beta propeller or other domain described in FIG. 4).

Figure 28:
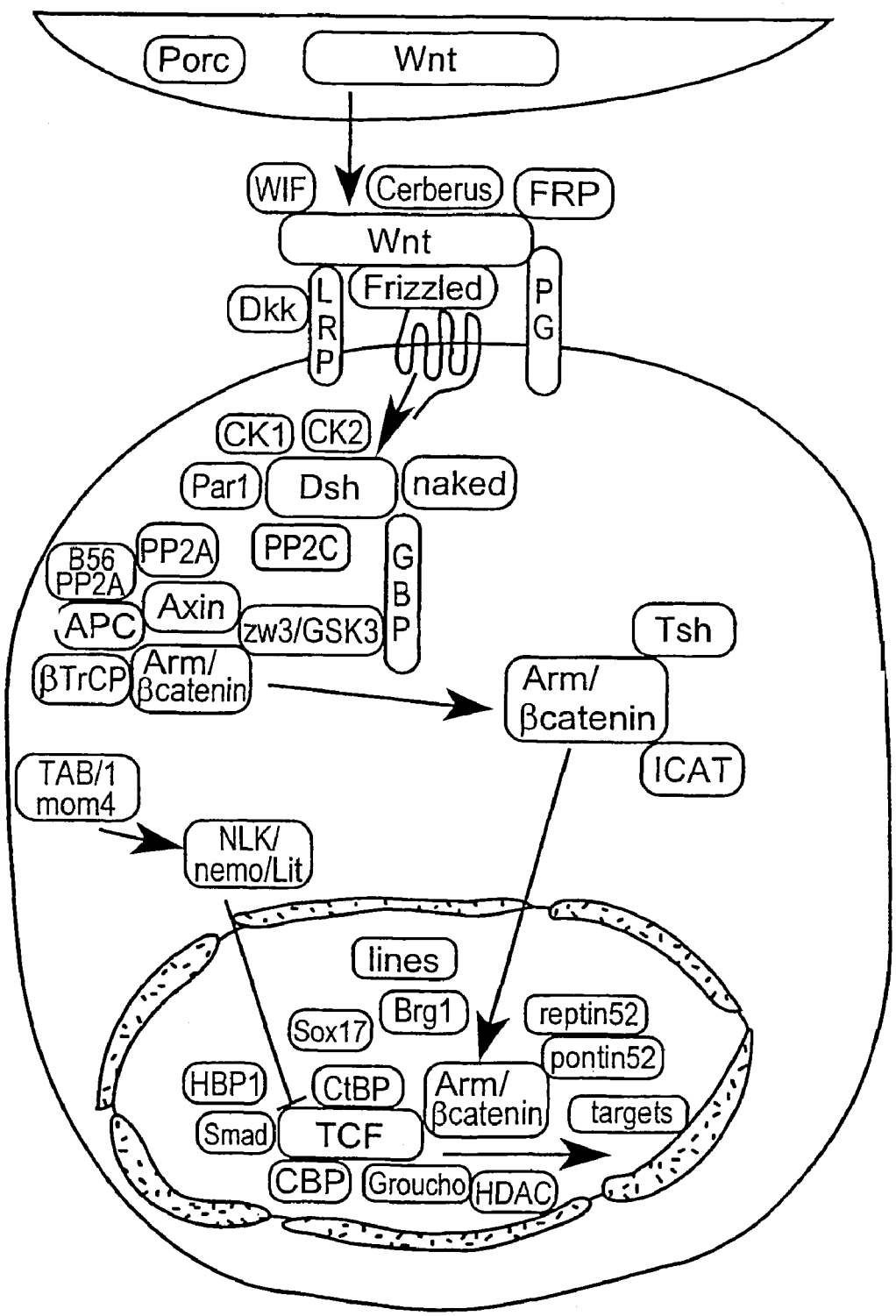
FIG. 28 shows a schematic of the components of the Wnt signal transduction pathway.

Recent studies have indicated that LRP5 participates in the Wnt signal transduction pathway. The Wnt pathway is critical in limb early embryological development. A recently published sketch of the components of Wnt signaling is shown in FIG. 28 (Nusse, 2001 *Nature* 411: 255-6; and Mao et al., 2001 *Nature* 411: 321-5).

Briefly summarized, Wnt proteins are secreted proteins which interact with the transmembrane protein Frizzled (Fz). LRP proteins, such as LRP5 and LRP6, are believed to modulate the Wnt signal in a complex with Fz (Tamai et al., 2000 *Nature* 407: 530-5). The Wnt pathway acts intracellularly through the Disheveled protein (Dsh) which in turn inhibits glycogen synthetase kinase-3 (GSK3) from phosphorylating β-catenin. Phosphorylated β-catenin is rapidly degraded following ubiquitination. However, the stabilized β-catenin accumulates and translocates to the nucleus where it acts as a cofactor of the T-cell factor (TCF) transcription activator complex.

The protein dickkopf-1 (Dkk-1) is reported to be an antagonist of Wnt pathway. Dkk-1 is required for head formation in early development (Glinka et al., 1998 *Nature* 391: 357-62). Dkk-1 and its function in the Wnt pathway are described in e.g., Krupnik, et al., 1999 *Gene* 238: 301-13; Fedi et al., 1999 *J. Biol. Chem.* 274: 19465-72; see also for Dkk-1 and the Wnt pathway, Wu et al., 2000 *Curr. Biol.* 10: 1611-4; Shinya et al., 2000 *Mech. Dev.* 98: 3-17; Mukhopadhyay et al., 2001 *Dev. Cell.* 1: 423-434; and in PCT Patent Application No. WO 00/52047, and in references cited in each. It has been known that Dkk-1 acts upstream of Dsh, however the nature of the mechanism of inhibition by Dkk-1 is just beginning to be elucidated. Dkk-1 is expressed in the mouse embryonic limb bud and its disruption results in abnormal limb morphogensis, among other developmental defects (Gotewold et al., 1999 *Mech. Dev.* 89:151-3; and Mukhopadhyay et al., 2001 *Dev. Cell.* 1: 423-34).

Related U.S. Ser. No. 60/291,311 (herein incorporated by reference in its entirety) disclosed a novel interaction between Dkk-1 (GenBank Accession No. XM 005730) and LRP5. The interaction between Dkk-1 and LRP5 was discovered by a yeast two hybrid (Y2H) screen for proteins which interact with the ligand binding domain of LRP5. The two-hybrid screen is a common procedure in the art, which is described, for example, by Gietz et al., 1997 *Mol. Cell. Biochem.* 172: 67-79; Young, 1998 *Biol. Reprod.* 58: 302-11; Brent et al., 1997 *Ann. Rev. Genet.* 31: 663-704; and Lu et al., eds., *Yeast Hybrid Technologies*, Eaton Publishing, Natick Mass., (2000). More recently, other studies confirm that Dkk-1 is a binding partner for LRP and modulates the Wnt pathway via direct binding with LRP (R. Nusse, 2001 *Nature* 411: 255-6; Bafico et al., 2001 *Nat. Cell Biol.* 3: 683-6; Semënov, 2001 *Curr. Biol.* 11: 951-61; Mao, 2001 *Nature* 411: 321-5 (2001); Zorn, 2001 *Curr. Biol.* 11: R592-5); and Li et al., 2002 *J. Biol Chem.* 277: 5977-81).

Mao and colleagues (2001) identified Dkk-1 as a ligand for LRP6. Mao et al. suggest that Dkk-1 and LRP6 interact antagonistically where Dkk proteins inhibit the Wnt coreceptor functions of LRP6. Using co-immunoprecipitation, the group verified that the Dkk-1/LRP6 interaction was direct. Dkk-2 was also found to directly bind LRP6. Contrary to data contained in provisional application 60/291,311, Mao et al. report that no interaction was detected between any Dkk protein and LRP5, as well as no interaction with LDLR, VLDLR, ApoER, or LRP). Additionally, Mao et al. demonstrated that LRP6 can titrate Dkk-1's effects of inhibiting Wnt signaling using the commercial TCF-luciferase reporter gene assay (TOPFLASH). A similar conclusion was drawn from analogous studies in *Xenopus* embryos. Deletion analyses of LRP6 functional domains revealed that EGF repeats (beta-propellers) 3 and 4 were necessary for Dkk-1 binding and that the ligand binding domains of LRP6 had no effect on Dkk-1 binding. The findings of Mao et al. contrast with data obtained by the present inventors indication that the ligand binding domains of LRP5 were necessary and sufficient for Dkk-1 binding in yeast. Using classical biochemical ligand-receptor studies, Mao et al. determined a Kd=0.34 nM for Dkk-1/LRP6 and a Kd=0.73 nM for Dkk-2/LRP6.

Semenov et al. (2001) verified the Mao group's results and confirmed by coimmunoprecipitation that Dkk-1 does not directly bind to Wnt or Frizzled but rather interacts with LRP6. Their Scatchard analyses found a Kd=0.5 nM for Dkk-1/LRP6. Semenov et al. also demonstrated that Dkk-1 could abolish an LRP5/Frizzled8 complex implying that Dkk-1 can also repress Wnt signaling via interactions with LRP5. A Dkk-1 mutant where cysteine 220 was changed to alanine abolished LRP6 binding and was unable to repress Wnt signaling. Studies in *Xenopus* embryos confirmed the results and revealed a functional consequence of Dkk-1/LRP6: repression of Wnt signaling. Their *Xenopus* work also suggested that LRP6/Dkk-1 may be specific for the canonical, β-catenin-mediated, Wnt pathways as opposed to the Wnt Planar Cell Polarity pathway.

Bafico et al. (2001) employed a $^{125}$I-labeled Dkk-1 molecule to identify LRP6 as its sole membrane receptor with a Kd=0.39 nM. Again, the functional consequences of the Dkk-1/LRP6 interaction was a repression of the canonical Wnt signaling even when Dkk-1 was added at extremely low concentrations (30 pM).

Not wishing to be bound by theory, it is believed that the present invention provides an explanation for the mechanism of Dkk-1 inhibition of the Wnt pathway and provides a mechanism whereby the Wnt pathway may be modulated. The present application and related U.S. Ser. No. 60/291,311 (which is herein incorporated by reference in its entirety) describe Dkk-1/LRP5 interactions and demonstrate that the interaction between LRP5/LRP6/HBM, and Dkk can be used in a method as an intervention point in the Wnt pathway for an anabolic bone therapeutic or a modulator of lipid metabolism.

As detailed in the Examples, Dkk-1 is able to repress LRP5-mediated Wnt signaling but not HBM-mediated Wnt signaling. This observation is of particular interest because the HBM mutation in LRP5 is a gain of function or activation mutation. That is, Wnt signaling via the canonical pathway, is enhanced with HBM versus LRP5. Thus, other HBM-like mutations would also function similarly. The present data suggest the mechanism of this functional activation: the inability of Dkk-1 to repress HBM-mediated Wnt signaling. Further investigations of other Wnt or Dkk family members show differential activities in the canonical Wnt pathway that demonstrate the complexity and variability in Wnt signaling that can be achieved depending on the LRP/Dkk/Wnt/Frizzled repertoire that is expressed in a particular cell or tissue. This may attest to the apparent bone specificity of the HBM or HBM like phenotypes in humans and in the HBM transgenic animals.

Furthermore, the present data reveal the importance and functional consequence for the potential structural perturbation of the first beta-propeller domain of LRP5. Our data identified the ligand binding domain of LRP5 as the interacting region with Dkk-1 while the Mao et al. publication demonstrated the functional role of propellers 3 and 4 in their LRP6/Dkk-1 studies. In the present invention, we implicate the first beta propeller domain, via the HBM mutation at residue 171, as having a functional consequence in the Dkk-1-mediated Wnt pathway. The involvement of position 171 of propeller 1 may be direct or indirect with Dkk-1. Direct involvement could arise from perturbations of the 3-dimensional structure of the HBM extracellular domain that render Dkk-1 unable to bind. Alternatively, residue 171 of propeller 1 may directly interact with Dkk-1; however, by itself, it is insufficient to bind and requires other LRP5 domains. Potential indirect candidate molecules may be among the proteins identified the Dkk-1 yeast-two-hybrid experiments.

It may be that the disruption of Dkk activity is not necessarily mediated by enhancing or preventing the binding of Dkk to LRP5/LRP6/HBM. More than one mechanism may be involved. Indeed, the inventors have observed that Dkk-1 binds LRP5, LRP6, and HBM. It is able to effectively inhibit LRP6, and to a slightly lesser extent, LRP5 activity. Further, has been observed that different members of the Dkk family differentially affect LRP5/LRP6/HBM activity. For example, Dkk-1 inhibits LRP5/LRP6/HBM activity while another Dkk may enhance LRP5/LRP6/HBM activity. An endpoint to consider is the modulation of the LRP5/LRP6/HBM activity, not simply binding.

The present disclosure shows that targeting the modulation of the Dkk-1/LRP5 interaction is a therapeutic intervention point for an HBM or IBM-like mimetic agent. A therapeutic agent of the invention may be a small molecule, peptide or nucleic acid aptamer, antibody, or other peptide/protein, etc. Methods of reducing Dkk-1 expression may also be therapeutic using methodologies such as: RNA interference (i.e., siRNAs), small hairpin RNAs (shRNAs), antisense oligonucleotides, morpholino oligonucleotides, PNAs, antibodies to Dkk-1 or Dkk-1 interacting proteins, decoy or scavenger LRP5 or LRP6 receptors, and knockdown of Dkk-1 or Dkk-1 interactor transcription. For discussion of small hairpin RNAs, see Yu et al., 2002 *Proc. Natl. Acad. Sci. USA* 99: 6047-52; Tuschl, 2002 *Nature Biotech.* 20: 446-8; Lee et al., 2002 *Nature Biotech.* 19: 500-5; Paddison et al., 2002 *Genes & Devel.* 16: 948-58; and Brummelkamp et al., 2002 *Science* 296: 550-3.

In an embodiment of the present invention, the activity of Dkk-1 or the activity of a Dkk-1 interacting protein may be modulated for example by binding with a peptide aptamer of the present invention. In another embodiment, LRP5 activity may be modulated by a reagent provided by the present invention (e.g., a peptide aptamer). In another embodiment, the Dkk-1/LRP5 interaction may be modulated by a reagent of the present invention (e.g., a Dkk-1 interacting protein such as those identified in FIG. 31). In another embodiment, the Wnt signal transduction pathway may be modulated by use of one or more of the above methods. In a preferred embodiment of the present invention, the Dkk-1 mediated activity of the Wnt pathway may be specifically modulated by one or more of the above methods. In another preferred embodiment of the present invention, the Wnt signal transduction pathway may be stimulated by down-regulating Dkk-1 interacting protein activity; such down-regulation could, for example, yield-greater LRP5 activity. In a more preferred embodiment, by stimulating LRP5 activity, bone mass regulation may be stimulated to restore or maintain a more optimal level. In another preferred embodiment, by stimulating LRP5 activity, lipid metabolism may be stimulated to restore or maintain a more optimal level. Alternative embodiments provide methods for screening candidate drugs and therapies directed to correction of bone mass disorders or lipid metabolism disorders. And, preferred embodiments of the present invention provide drugs and therapies developed by the use of the reagents and/or methods of the present invention. One skilled in the art will understand that the present invention provides important research tools to develop an effective model of osteoporosis, to increase understanding of bone mass and lipid modulation, and to modulate bone mass and lipid metabolism. For a more detailed description of Dkk-1 and Dkk-1 interacting protein modulation, please refer to U.S. Ser. No. 60/361,293, which is herein incorporated by reference in its entirety.

3. Alternative Variants of LRP5/LRP6 Having HBM Activity

A structural model of the LRP5/Zmax1 first beta-propeller module was generated based on a model prediction in Springer et al., 1998 *J. Mol. Biol.* 283: 837-862. Based on the model, certain amino acid residues were identified as important variants of LRP5/HBM/Zmax1. The model and modifications thereof are discussed in more detail in the Examples. The following three categories provide examples of such variants:

The shape of the beta-propeller resembles a disk with inward-sloping sides and a hole down the middle. Residue 171 is in a loop on the outer or top surface of the domain in blade 4 of propeller module 1. Thus, variants comprising changed residues in structurally equivalent positions in other blades; as well as residues that are slightly more interior to the binding pocket, but still accessible to the surface, are important embodiments of the present invention for the study of bone mass modulation by LRP5/HBM, for the development of pharmaceuticals and treatments of bone mass disorders, and for other objectives of the present invention. The following Table contains examples of such variants:

TABLE 1

| Variant | Effect of Mutation |
|---|---|
| A214V | a position equivalent to 171 in blade 5 of propeller 1; alanine is not conserved in other propellers |
| E128V | a position equivalent to 171 in blade 3 of propeller 1; glutamate is not conserved in other propellers |
| A65V | a position equivalent to 171 in blade 2 of propeller 1; alanine is conserved in propellers 1-3 but not 4 |
| G199V | an accessible interior position in blade 5 of propeller 1; glycine is conserved in propellers 1-3 but not 4 |
| M282V | accessible interior position in blade 1 of propeller 1; methionine is conserved in propellers 1-3 but not 4 |

These mutations were further analyzed based on a more sophisticated model, as discussed and described in Example 11 below.

LRP5/Zmax1 has four beta-propeller structures; the first three beta-propeller modules conserve a glycine in the position corresponding to residue 171 in human LRP5/Zmax1. Therefore, variants bearing a valine in the equivalent positions in the other propellers are important embodiments of the present invention. The following variants are useful for the study of bone mass modulation by LRP5/HBM, for the development of pharmaceuticals and treatments of bone mass disorders, and for other objectives of the present invention: G479V, G78 IV, and Q1087V of SEQ ID NO: 3, which demonstrate that propeller 1 is an important determinant of an HBM or HBM-like effect.

Figure 29:
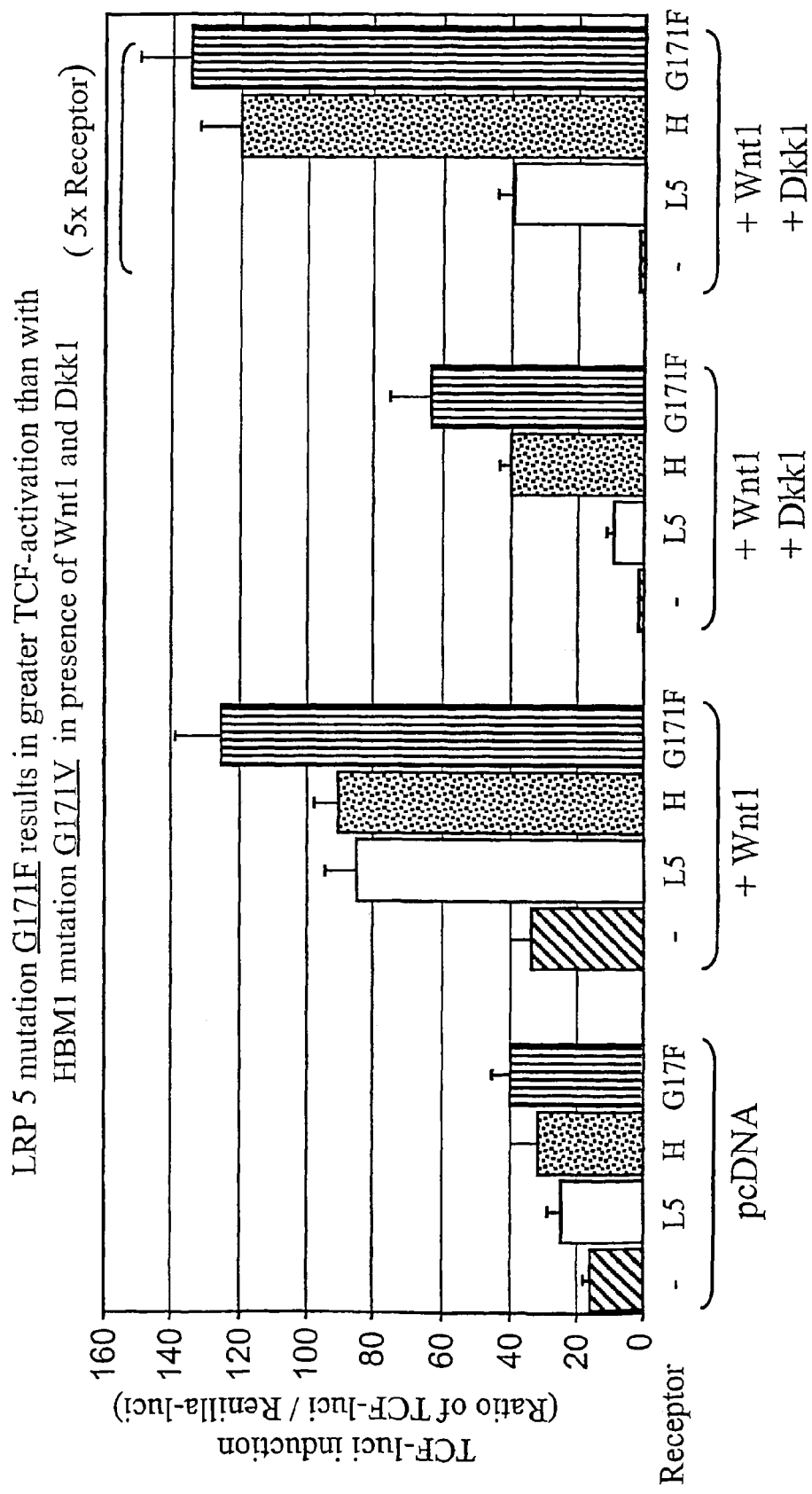
FIG. 29 shows that the mutation G171F in LRP5 produces a greater activation of the Wnt pathway than LRP5 which is consistent with HBM activity.
Figure 30:
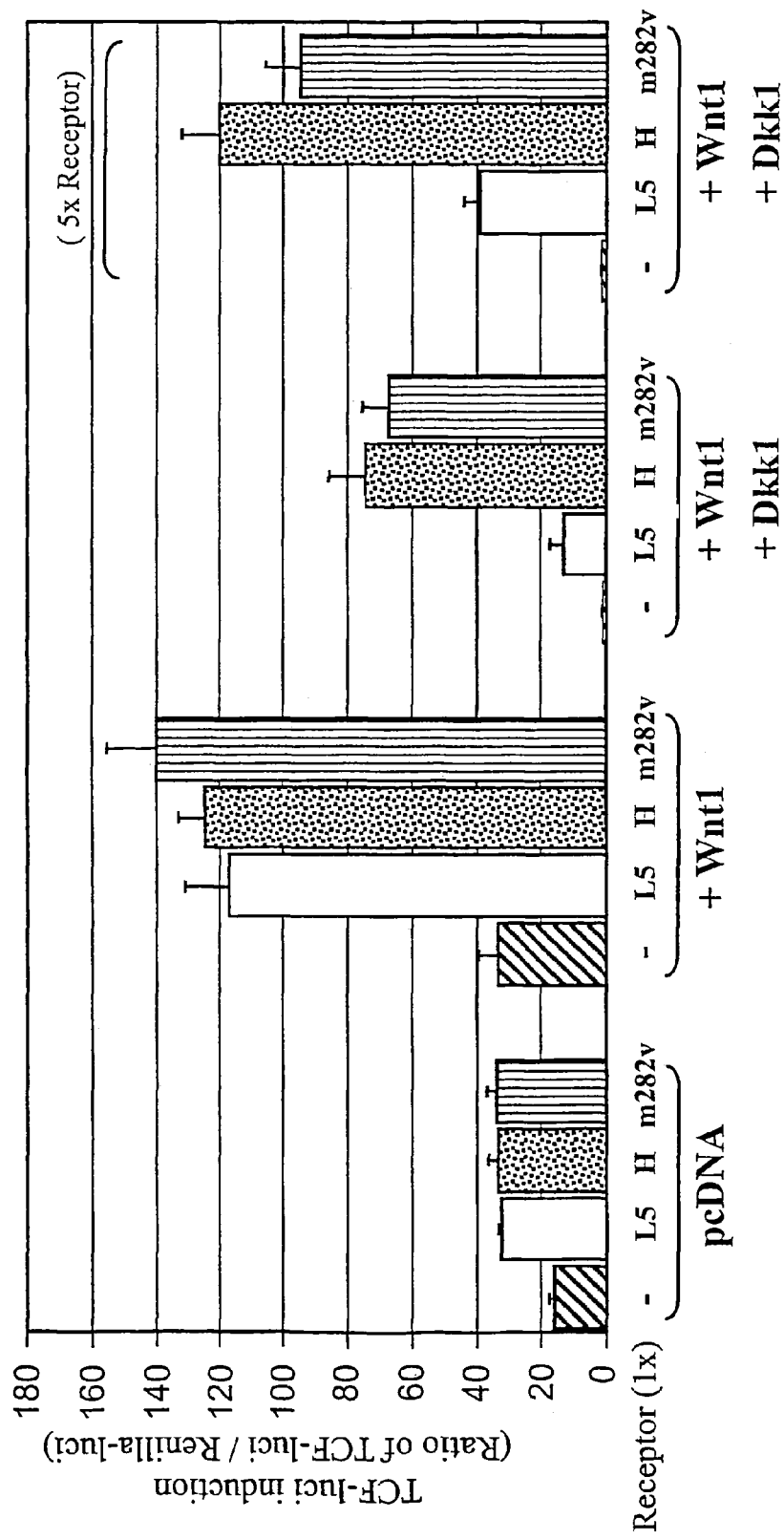
FIG. 30 shows that the mutation M282V in LRP5 produces an activation of the Wnt pathway which is consistent with HBM activity in U2OS cells.

The G171V HBM polymorphism (SEQ ID NO: 4) results in "occupied space" of the beta-propeller 1, with the side-chain from the valine residue sticking out into an open binding pocket and potentially altering a ligand/protein interaction. The glycine residue is conserved in LRP5/Zmax1 propellers 1, 2 and 3 but is a glutamine in propeller 4. Therefore, the following variants of LRP5/HBM are important embodiments of the present invention for the study of bone mass modulation by LRP5/HBM, for the development of pharmaceuticals and treatments of bone mass disorders, and for other objectives of the present invention:

G171K: introduces a charged side-chain
G171F: introduces a ringed side-chain
G171I: introduces a branched side-chain
G171Q: introduces the propeller 4 residue These substitutions along with substitutions in other regions of propeller 1 of SEQ ID NO: 3 (i.e., A214V and M282V) have been shown to produce an HBM-like effect by TCF assay (FIGS. 29 and 30). Thus these substitutions in other propeller 1 domains would similarly have an expectation of producing an HBM-like phenotype readily assayable by TCF assay.

Furthermore, LRP6 is the closest homolog of LRP5/Zmax1. LRP6 has a beta-propeller structure predicted to be similar, if not identical to Zmax1. The position corresponding to glycine 171 of human LRP5/Zmax1 is glycine 158 of human LRP6. Thus, corresponding variants of LRP6 are an important embodiment of the present invention for the study of the specificity of LRP5/Zmax1 versus its related family member, for the development of pharmaceuticals and treatments of bone mass disorders, and for other objectives of the present invention. Specifically, for example, a glycine to valine substitution at the structurally equivalent position, residue 158, of human LRP6 and similar variants of other species' LRP6 homologs represent important research tools.

Site-directed mutants of LRP5 were generated in the full-length human LRP5 cDNA using the QuikChange XL-Site-Directed Mutagenesis Kit (catalog #200516, Stratagene, La Jolla, Calif.) following the manufacturer's protocol. The mutant sequences were introduced using complementary synthetic oligonucleotides (SEQ ID NOS: 776-801. respectively, in order of appearance):

| Mutation | Complementary oligos |
|---|---|
| A65V: | 5'-TGGTCAGCGGCCTGGAGGATGTGGCCGCAGTGGACTTCC-3' |
| | 5'-GGAAGTCCACTGCGGCCACATCCTCCAGGCCGCTGACCA-3' |
| E128V | 5'-AAGCTGTACTGGACGGACTCAGTGACCAACCGCATCGAGG-3' |
| | 5'-CCTCGATGCGGTTGGTCACTGAGTCCGTCCAGTACAGCTT-3' |
| G171K | 5'-ATGTACTGGACAGACTGGAAGGAGACGCCCCGGATTGAGCG-3' |
| | 5'-CGCTCAATCCGGGGCGTCTCCTTCCAGTCTGTCCAGTACAT-3' |
| G171F | 5'-ATGTACTGGACAGACTGGTTTGAGACGCCCCGGATTGAGCG-3' |
| | 5'-CGCTCAATCCGGGGCGTCTCAAACCAGTCTGTCCAGTACAT-3' |
| G171I | 5'-ATGTACTGGACAGACTGGATTGAGACGCCCCGGATTGAGCG-3' |
| | 5'-CGCTCAATCCGGGGCGTCTCAATCCAGTCTGTCCAGTACAT-3' |
| G171Q | 5'-ATGTACTGGACAGACTGGCAGGAGACGCCCCGGATTGAGCG-3' |
| | 5'-CGCTCAATCCGGGGCGTCTCCTGCCAGTCTGTCCAGTACAT-3' |
| G199V | 5'-CGGACATTTACTGGCCCAATGTACTGACCATCGACCTGGAGG-3' |
| | 5'-CCTCCAGGTCGATGGTCAGTACATTGGGCCAGTAAATGTCCG-3' |
| A214V | 5'-AGCTCTACTGGGCTGACGTCAAGCTCAGCTTCATCCACCG-3' |
| | 5'-CGGTGGATGAAGCTGAGCTTGACGTCAGCCCAGTAGAGCT-3' |

-continued

| Mutation | Complementary oligos |
|---|---|
| M282V | 5'-GAGTGCCCTCTACTCACCCGTGGACATCCAGGTGC TGAGCC-3'<br><br>5'-GGCTCAGCACCTGGATGTCCACGGGTGAGTAGAGG GCACTC-3' |
| G479V | 5'-CATGTACTGGACAGACTGGGTAGAGAACCCTAAAA TCGAGTGTGC-3'<br><br>5'-GCACACTCGATTTTAGGGTTCTCTACCCAGTCTGT CCAGTACATG-3' |
| G781V | 5'-CATCTACTGGACCGAGTGGGTCGGCAAGCCGAGGA TCGTGCG-3'<br><br>5'-CGCACGATCCTCGGCTTGCCGACCCACTCGGTCCA GTAGATG-3' |
| Q1087V | 5'-GTACTTCACCAACATGGTGGACCGGGCAGCCAAGA TCGAACG-3'<br><br>5'-CGTTCGATCTTGGCTGCCCGGTCCACCATGTTGGT GAAGTAC-3' |
| G158V of LRP6 | 5'-GTACTGGACAGACTGGGTAGAAGTGCCAAAGATAG AACGTGC-3'<br><br>5'-GCACGTTCTATCTTTGGCACTTCTACCCAGTCTGT CCAGTAC-3' |

All constructs were sequence verified to ensure that only the engineered modification was present in the gene. Once verified, each variant was functionally evaluated in the TCF-luciferase assay in U2OS cells (essentially as described in Example 6. Other functional evaluations could also be performed, such as the *Xenopus* embryo assay (essentially as described in Example 5), or other assays to evaluate Wnt signaling, Dkk modulation, or anabolic bone effect. Binding of these mutants to Dkk, LRP-interacting proteins, Dkk-interacting proteins, or peptide aptamers to any of the preceding could also be investigated in a variety of ways such as in a two-hybrid system (such as in yeast as described in this application), or other methods.

FIG. 29 shows the effects of the G171F mutation in propeller 1 of LRP5. This mutation is at the same position as HBM's G171V substitution. Expression of G171F results in an HBM effect. That is, in the presence of Wnt, G171F is able to activate the TCF-luciferase reporter construct. In fact, it may activate the reporter to a greater extent than either LRP5 or HBM. Furthermore, in the presence of Dkk1 and Wnt1, G171F is less susceptible than LRP5 to modulation by Dkk. These data exemplify that the G171F variant modulates Wnt signaling in a manner similar to HBM. In addition, this data confirms that HBM's valine residue at 171 is not the only modification at 171 that can result in an HBM effect. Together these data support an important role for LRP5 propeller 1 in modulating Wnt pathway activity; in responding to Dkk modulation; and, in the ability to generate an HBM effect.

FIG. 30 shows the effects of the M282V mutation in propeller 1 of LRP5. M282 expression results in an HBM-effect. That is, in the presence of Wnt, M282 is able to activate the TCF-luciferase reporter construct. Furthermore, in the presence of Dkk1 and Wnt1, M282V is less susceptible than LRP5 to modulation by Dkk. These data show that the M282V variant modulates Wnt signaling in a maimer similar to HBM. In addition, this data confirms that modifications of other residues in propeller 1 of LRP5 can result in an HBM effect.

These data support an "occupied space" model of the HBM mutation in propeller 1 and show that multiple mutations of propeller 1 are capable of generating an HBM effect; the original G171V HBM mutation is not unique in this ability. Moreover, various perturbations in propeller 1 can modulate Dkk activity.

These data illustrate the molecular mechanism of Dkk modulation of LRP signaling. Using the methods disclosed herein and in U.S. Application 60/290,071, generation of a comprehensive mutant panel will reveal residues in LRP that function in Dkk modulation of Wnt signaling. Such variants of LRP5 and LRP6 that modulate Dkk activity and the residues which distinguish them from LRP5 and LRP6 are points for therapeutic intervention by small molecule compound, antibody, peptide aptamer, or other agents. Furthermore, models of each HBM-effect mutation/polymorphism may be used in rational drug design of an HBM mimetic agent.

These and the examples provided infra are only a few illustrative examples presented to better describe the present invention. Variants of LRP5 which have demonstrated HBM activity in assays include A65V, G171I, G171V (HBM), G171F, M282V, G171K, G171Q and A214V. Clearly, other variants may be contemplated within the scope of the present invention. Furthermore, wherever HBM is recited in the methods of the invention, it should be understood that any such alternative variant of LRP5 or LRP6 which demonstrates HBM like biological activity is also encompassed by those claims.

Additional mutations may also result in conformational changes such as those described above and in the Examples below. These mutations may also result in a HBM-like phenotype when expressed. The following mutations have been identified in Table 2 based on familial genetics in the exons of Zmax1 (LRP5).

TABLE 2

Mutations in the Exons of LRP5
(SEQ ID NOS:802-818, respectively,
in order of appearance)

| Exon | Location (ATG as nt 1) | Reference | Met Change | AA as AA1 | Change |
|---|---|---|---|---|---|
| 2 | 249 | CGAGGAGGCCATC | C/T | S83 | None |
| 2 | 266 | AGACCTACCT | A/G | Q89 | G→R |
| 3 | 512 | GTGAGACGCC | G/T | G171 | G→V |
| 6 | 1199 | CGTACCTGGACGGG | C/T | A400 | A→V |
| 8 | 1647 | CGGGTTCACGCTGC | C/T | F549 | None |
| 9 | 1932 | GGCCTTCTTGGTCT | G/A | E644 | None |
| 9 | 1999 | GTGGCCATCCCGCT | G/A | V667 | V→M |
| 10 | 2220 | CAGAATCGAAGTG | C/T | N740 | None |
| 14 | 3107 | GGACACTGTT | G/A | R1036 | R→Q |
| 15 | 3297 | CGGCACCGAGCG | C/T | D1099 | None |

TABLE 2-continued

Mutations in the Exons of LRP5
(SEQ ID NOS:802-818, respectively,
in order of appearance)

| Exon | Location (ATG as nt 1) | Reference | Met Change | AA as AA1 | AA Change |
|---|---|---|---|---|---|
| 15 | 3357 | AGACAACACACTG | A/G | V1119 | None |
| 16 | 3564 | GACTCGCATC | G/A | R1188 | None |
| 18 | 3989 | CGGACTGTGA | C/T | A1330 | A→V |
| 20 | 4137 | CAGCCCGGCCCAC | C/T | D1379 | None |
| 20 | 4248 | GGGGGCCAACGG | G/A | A1416 | None |
| 20 | 4565 | CGGCCACTGC | C/T | P1522 | P→L |
| 23 | 4635 | CGACGTGTGTGACA | C/T | T1545 | None |

By, for example "C/T" is meant there is a C to T mutation.

Additional mutations have also been identified in the introns, which may result in splice variants are provided in Table 3 below.

TABLE 3

Mutations in the Introns of LRP5
(SEQ ID NOS:819-844, respectively,
in order of appearance)

| Exon | Nucleotide Position with respect to Exon | Sequence with SNP Location Underlined | Nucleotide |
|---|---|---|---|
| 2 | +53 | CTCTCTCTCGAATT | C/T |
| 5 | -4 | TCAGTCCACACTCG | T/C |
| 5 | +8 | GGGCGGGGGCTGGG | G/A |
| 7 | -50 | GCAGAGACCAGAC | G/A |
| 8 | -118 | TGCTCTTGGGCATT | T/G |
| 9 | -131 | TGGGGGTGAGTCCT | T/C |
| 10 | +6 | TGTTTGCCTGTCCC | T/C |
| 11 | -173 | ATGTGTGTGGCAG | A/G |
| 11 | -152 | GGTCTCGCCCTTC | G/A |
| 11 | -49 | CGGTGAGAGCAGAC | C/T |
| 11 | +37 | CGGGGCAGCCGGG | C/T |
| 11 | +78 | GTACCCTGTGGCCT | G/A |
| 12 | +80 | CTCATCTGGGGTTC | C/G |
| 12 | +141 | ATGATGCTACCTGG | A/G |
| 15 | -166 | CGGGAATTTGGAGA | C/T |
| 15 | -149 | TTGTTCAACTAGTA | T/C |
| 15 | -52 | TCCGAGGAGACGC | T/G |
| 17 | -213 | TTGTTTCCGGCATC | T/C |
| 17 | -82 | CATTTGGCCCCTA | C/T |
| 18 | -72 | GCCCAGTCAC | G/A |
| 18 | -63 | CGCCATTGCC | C/T |
| 18 | -30 | GTGTGATGTT | G/A |
| 18 | +23 | TGATCTGGAGGAGG | T/C |
| 18 | +47 | GTCTGGGCAGCTTT | G/C |
| 18 | +54 | CACCGTCAGTGCT | C/A |
| 22 | -118 | GGCACCTGCC | G/A |

These splice variants may also produce an altered phenotype capable of conferring a HBM-like effect.

These mutations were identified using 80 ng of genomic DNA, which was PCR amplified with the primers indicated in Table 4 below with M13F (TGTAAAACGACGGCCAGT) (SEQ ID NO: 845) attached to the 5' end of the Forward primer or M13R (AGGAAACAGCTATGACCAT) (SEQ ID NO: 846) attached to the 5' end of the Reverse primer. 4 µl of the PCR reaction was diluted to a final volume of 100 µl with water. Sequencing was performed using ET and M13F and M13R primers or by the ABI-PRISM® Big-Dye™ method of Applied Biosystems using the indicated nested sequencing primers. The sequences are assembled on consed with the appropriate reference sequence.

The PCR mixes used are as follows

Promega: 50 mM KCl, 10 mM Tris-HCl, pH 9.0, 0.1% Triton X-100, 1.5 mM $MgCl_2$

Invitrogen D: 60 mM Tris-HCl, pH 8.5, 15 mM $(NH_4)_2SO_4$, 3.5 mM $MgCl_2$

Invitrogen J: 60 mM Tris-HCl, pH 9.5, 15 mM $(NH_4)_2SO_4$, 2.0 mM $MgCl_2$

Invitrogen M: 60 mM Tris-HCl, pH 10.0, 15 mM $(NH_4)_2SO_4$, 1.5 mM $MgCl_2$

To all the PCT mixes, 120 µM of all 4 dNTPs was added, 0.4 µM of the forward and reverse primers, 80 ng genomic DNA, 1 U of AmpliTaq® DNA polymerase, and 1.1 U of TaqStart antibody (Clontech). The PCR reaction is than run as follows: 94° C., 2 min; (94° C., 30 sec; X-anneal-temp, 30 sec; 72° C., 2 min) for 35 cycles and 72° C. for 3 min.

TABLE 4

Forward and Reverse Primers
(SEQ ID NOS:847-942, respectively, in order of appearance)

| Exon | F-primer (PCR) | R-primer (PCR) | anneal temp | Prod. Size | PCR buffer | F-primer (seq) | R-primer (seq) |
|---|---|---|---|---|---|---|---|
| 1 | GAGACGCGGCGCGGCTTC | CGCCCCAACTCGCTCCCAAC | 2-cycle-68 | 429 | dmso | TCCCGCGCGCCCAGCTC | TCGCCAAGTCGCTTCCG |
| 2 | AAGGAACTGGAGGTCTTG | CAGAGTCACACCCTTTTTC | 62 | 670 | promega | GGCATGGGCAGGGCAGT | TGAAAAACAACTTGGGCTC |
| 3 | CCAAGTTCTGAGAAGTCC | AATACCTGAAACCATACCTG | 58 | 523 | promega | TGCATTCCTCAGGGCCC | TTGGTTATTTCCGATGGG |
| 4 | GGCGTAGTGGTGGGCATCAG | CCCAGCCAGCCACACACCTC | 62 | 680 | dmso | ACTGTCGGGGACCCTC | ATTGCAGCAGGTACCCC |
| 5 | GGGAAATTGCAGGCCGTCTG | CTGAGGACCAAGGCGGAGAG | 58 | 633 | promega | AGGCTGAGGGCCCCATG | CAGGATTGACCTCCTGG |
| 6 | CACCTAACATCACCAGCC | GATGCAAGACAGTGTCCC | 62 | 672 | promega | CCTGGCTGAGTATTTCC | TCAATCTCCCTCTCGCC |
| 7 | ACACCGACATTTACGAGCAC | AAATAGCAGAGCACAGGCAC | 58 | 484 | promega + 10% dmso | CGACATTTACTGACACCA | CCATCGGTGCCTCGCCA |
| 8 | TCTCAAACAAACAAACAAACAAAAA | TCCTTGGCCAGATACTGTCAC | 60 | 638 | promega | ACAAACAAACAAAGCGTCA | CTTTCCTGTCCTGCCCT |
| 9 | TGTGTGGCGGGAATAAAG | TTGAGGCAGGAACAGAGG | 60 | 648 | promega | CTGTGCACATTGGAGCT | CAAGGTTTTCCCATAAAGG |
| 10 | ATGTCTACAAAACACGCT | CTAATCACTGAGGGCCACG | 60 | 744 | promega | GTTCTGGCCTGGCGTGG | ACGGACAGCCTGCCACC |
| 11 | TCACCTTACGAGTGAGCC | AGCCTCTCCCGACATAAC | 60 | 677 | promega | ACTGTGGGAATTCAGGG | TGCAGCAAAGGCACCCA |
| 12-1 | GAAAACCAGCAAAAGCCC | TGTCCATCACGAAGTCCAG | 60 | 677 | promega | ATGAGGGCGGCCATGTG | GCGGTTCCGGCCGCTAG |
| 12-2 | ACAGCGATTATATCTACTGGAC | ATGGAAAGCACTCAGCAC | 60 | 622 | promega | AGACTGGAATCTGCACAG | TGTGCTGGCAGTATGAG |
| 13 | AGAATGAAAATTCCCCATAGCG | AGACAAAAGTCCTGTGGGGTC | 52 | 676 | Invitrogen D | TCCCGTGGACCTCCAGC | ACAACGGGGAAACCCAG |
| 14 | GAGAGACCCCCACACCAATAC | CAGGTGGAAAGTCTCCCCAG | 63 | 571 | promega | TGGGATTTGACTTTCAG | CCTGTGAGAGGCTGGCAG |
| 15 | CAGTTGGATTTAGGGCCTACC | CAGCTGTCAGTGTGAGGACAA | 60 | 656 | promega | CTCACCCATTGTGGTCG | AACACGCTACACACAAAG |
| 16 | AACTGATGGCCTTCATCCC | TCTTAAAACGCTGTTCGTGGT | 60 | 699 | promega | GAGCCCAGCCCAGGTGG | GATTTGTTCTGCGGCAAAAG |
| 17 | AGACTGATGGTATGGGCACAG | ATTTGTGAGATGCAGGAACG | 60 | 662 | promega | TAGAGACTGGTGCAGAC | CAGTACTTAGAGGAAAATTC |
| 18 | ATTCTCCCAGCCTCTCTTCTG | GCAGGAAGGTGAGATAGACCC | 58 | 722 | promega | GGTTGGGGCTGGAGGTG | TCACAGTCTGCCTTCAAG |
| 19 | GGGGTCTGTTACTCCTTGCAT | CAGCTCACAGTCTGTCCTCCT | 60 | 645 | promega | GGCGTAGACCTCCCCAC | CCGCTGCCCTGGGAAAG |
| 20 | ACGTTACCCTGAGGTTGGC | AGGCCTCTGTGTTGAAGGATT | 60 | 640 | promega | AGGCTCCCCAGGCCTAG | CTGATGCCAAGCACAGG |
| 21 | TTGGAGGAGGTACCATGTGTC | GGTGGATTTGGGTGAGATTTT | 55 | 643 | Invitrogen J | TCCCGTTTCACAGATGAG | CAGATTATCCACAATCAAC |
| 22 | TTCTGCTGATTTCTGAACCC | TTGCCTTTCACTGAGATGAC | 58 | 558 | promega + 10% dmso | AACATGCAGTGCCCGCT | CTTCGGGGCAGGTGGCT |
| 23 | GGCCTGCATCTTCTGGAGC | CATTCCCTCCACGGGGACC | 62 | 683 | promega | TGGCCAGTGGACAGGCC | ACACAACTCAAATGCACAC |

4. Genotyping, of Microsatellite Markers

To narrow the genetic interval to a region smaller than that originally reported by Johnson et al., 1997 *Am. J. Hum. Genet.*, 60:1326-1332, additional microsatellite markers on chromosome 11q12-13 were typed. The new markers included: D11S4191, D11S1883, D11S1785, D11S4113, D11S4136, D11S4139, (Dib et al., 1996 *Nature*, 380:152-154), FGF3 (Polymeropolous et al., 1990 *Nucl. Acid Res.*, 18: 7468), as well as GTC_HBM_Marker_1, GTC_HBM_Marker_2, GTC_HBM_Marker_3, GTC_HBM_Marker_4, GTC_HBM_Marker_5, GTC_HBM_Marker_6, and GTC_HBM_Marker_7 (See FIG. 2).

Blood (20 ml) was drawn into lavender cap (EDTA containing) tubes by a certified phlebotomist. The blood was stored refrigerated until DNA extraction. DNA has been extracted from blood stored for up to 7 days in the refrigerator without reduction in the quality or quantity of yield. For those subjects that have blood drawn at distant sites, a shipping protocol was successfully used on more than a dozen occasions. Blood samples were shipped by overnight express in a styrofoam container with freezer packs to provide cooling. Lavender cap tubes were placed on individual plastic shipping tubes and then into "zip-lock" biohazard bags. When the samples arrived the next day, they were immediately processed to extract DNA.

The DNA extraction procedure used a kit purchased from Gentra Systems, Inc. (Minneapolis, Minn.). Briefly, the procedure involved adding 3 volumes of a red blood cell lysis buffer to the whole blood. After incubations for 10 minutes at room temperature, the solution was centrifuged in a Beckman tabletop centrifuge at 2,000×g for 10 minutes. The white blood cell pellet was resuspended in Cell Lysis Buffer. Once the pellet was completely resuspended and free of cell clumps, the solution was digested with RNase A for 15 minutes at 37° C. Proteins were precipitated by addition of the provided Protein Precipitation Solution and removed by centrifugation. The DNA was precipitated out of the supernatant by addition of isopropanol. This method was simple and fast, requiring only 1-2 hours, and allowed for the processing of dozens of samples simultaneously. The yield of DNA was routinely >8 mg for a 20 ml sample of whole blood and had a MW of >50 kb. DNA was archived by storing coded 50 μg aliquots at −80° C. as an ethanol precipitate.

DNA was genotyped using one fluorescently labeled oligonucleotide primer and one unlabeled oligonucleotide primer. Labeled and unlabeled oligonucleotides were obtained from Integrated DNA Technologies, Inc. (Coralville, Iowa). All other reagents for microsatellite genotyping were purchased from Perkin Elmer-Applied Biosystems, Inc. ("PE-ABI") (Norwalk, Conn.). Individual PCR reactions were performed for each marker, as described by PE-ABI using AmpliTaq™ DNA Polymerase. The reactions were added to 3.5 μl of loading buffer containing deionized formamide, blue dextran and TAMRA 350 size standards (PE-ABI). After heating at 95° C. for 5 minutes to denature the DNA, the samples were loaded and electrophoresed as described in the operator's manual for the Model 377 DNA Sequencer (PE-ABI, Foster City, Calif.). After gel electrophoresis, the data was analyzed using PE-ABI GENESCAN™ and GENOTYPER™ software. First, within the GENESCAN™ software, the lane tracking was manually optimized prior to the first step of analysis. After the gel lane data was extracted, the standard curve profiles of each lane were examined and verified for linearity and size calling. Lanes, which had problems with either of these parameters, were re-tracked and verified. Once all lanes were tracked and the size standards were correctly identified, the data were imported into GENOTYPER™ for allele identification To expedite allele calling (binning), the program Linkage Designer from the Internet web-site of Dr. Guy Van Camp was used. This program greatly facilitates the importing of data generated by GENOTYPER™ into the pedigree drawing program Cyrillic (Version 2.0, Cherwell Scientific Publishing Limited, Oxford, Great Britain) and subsequent linkage analysis using the program LINKAGE (Lathrop et al., 1985 *Am. J. Hum. Genet.* 37: 482-98).

5. Linkage Analysis

Figure 1B:
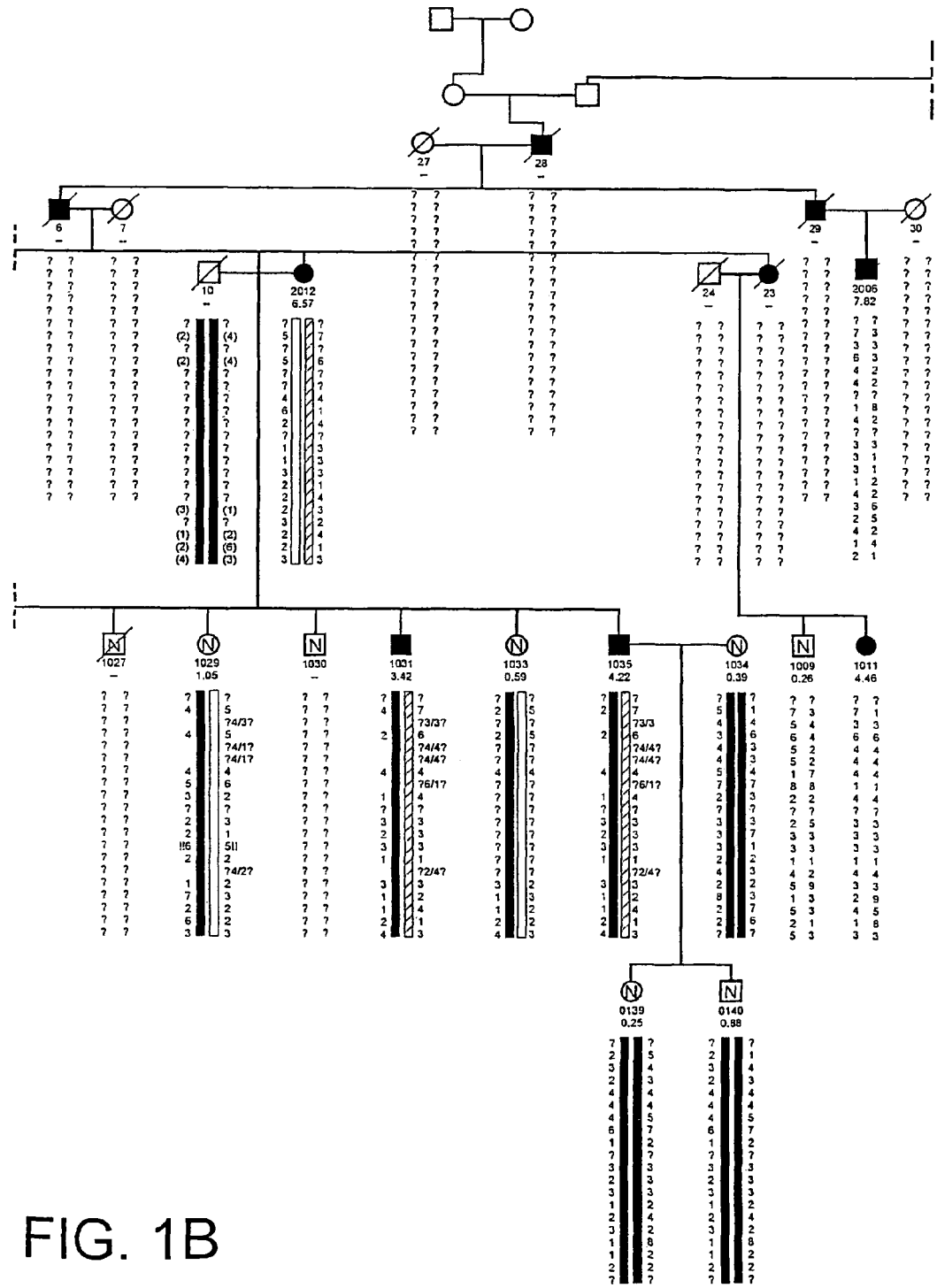

FIG. 1 demonstrates the pedigree of the individuals used in the genetic linkage studies for this invention. Specifically, two-point linkage analysis was performed using the MLINK and LINKMAP components of the program LINKAGE (Lathrop et al., 1985 *Am. J. Hum. Genet.*, 37: 482-98). Pedigree/marker data was exported from Cyrillic as a pre-file into the Makeped program and converted into a suitable ped-file for linkage analysis.

The original linkage analysis was performed using three models: (i) an autosomal dominant, fully penetrant model, (ii) an autosomal dominant model with reduced penetrance, and (iii) a quantitative trait model. The HBM locus was mapped to chromosome 11q12-13 by analyzing DNA for linked markers from 22 members of a large, extended kindred. A highly automated technology was used with a panel of 345 fluorescent markers which spanned the 22 autosomes at a spacing interval ranging from 6-22 cM. Only markers from this region of chromosome 11 showed evidence of linkage (LOD score ~3.0). The highest LOD score (5.74) obtained by two-point and multipoint analysis was D11S987 (map position 55 in FIG. 2). The 95% coiifidence interval placed the HBM locus between markers D11S905 and D11S937 (map position 41-71 in FIG. 2). Haplotype analysis also places the Zmax1 (LRP5) gene in this same region. Further descriptions of the markers D11S987, D11S905, and D11S937 can be found in Gyapay et al., 1994 *Nature Genetics*, Vol. 7.

In this invention, the inventors report the narrowing of the HBM interval to the region between markers Dl 15987 and GTC_HBM_Marker_5. These two markers lie between the delimiting markers from the original analysis (D11S905 and D11S937) and are approximately 3 cM from one another. The narrowing of the interval was accomplished using genotypic data from the markers D11S4191, D11S1883, D11S1785, D 11S4113, D 11S4136, D 11S4139, (Dib et al., 1996 *Nature* 380: 152-4), FGF3 (Polymeropolous et al., 1990 *Nucl. Acid Res.*, 18: 7468) (information about the genetic markers can be found at the Internet site of the Genome Database, as well as the markers GTC_HBM_Marker 1, GTC_HBM_Marker 2, GTC_HBM_Marker_3, GTC_HBM_Marker 4, GTC_HBM_Marker_5, GTC_HBM_Marker_6, and GTC_HBM_Marker_7.

As shown in FIG. 1, haplotype analysis with the above genetic markers identifies recombination events (crossovers) in individuals 9019 and 9020 that significantly refine the interval of chromosome 11 to which the Zmax1 (LRP5) gene is localized. Individual 9019 is an HBM-affected individual that inherits a portion of chromosome 11 from the maternal chromosome with the HBM gene, and a portion from the chromosome 11 homologue. The portion inherited from the HBM gene-carrying chromosome includes markers D11S935, D11S1313, GTC_HBM_Marker_4, D11S987, D11S1296, GTC_HBM_Marker_6, GTC_HBM_Marker_2, D11S970, GTC_HBM_Marker_3, D11S4113, GTC_HBM_Marker_1, GTC_HBM_Marker_7 and GTC_HBM_Marker_5. The portion from D11S4136 and continuing in the telomeric direction is derived from the non-HBM chromosome. This data places the Zmax1 (LRP5) gene in a location centromeric to the marker GTC_HBM_Marker_5. Individual 9020 is an unaffected individual who also exhibits a critical recombination event. This individual inherits a recombinant paternal chromosome 11 that includes markers D11S935, D11S1313, GTC_IBM_Marker_4, D11S987, D11S1296 and GTC_HBM_Marker_6 from her father's (individual 0115) chromosome 11 homologue that carries the HBM gene, and markers GTC_HBM_Marker_2, D11S970, GTC_HBM_Marker_3, GTC_HBM_Marker_1, GTC_HBM_Marker_7, GTC_HBM_Marker_5, D11S4136, D11S4139, D11S1314, and D11S937 from her father's chromosome 11 that does not carry the HBM gene. Marker D11S4113 is uninformative due to its homozygous nature in individual 0115. This recombination event places the centromeric boundary of the HBM region between markers D11S1296 and D11S987.

Two-point linkage analysis was also used to confirm the location of the Zmax1 (LRP5) gene on chromosome 11. The linkage results for two point linkage analysis under a model of full penetrance are presented in Table 5 below. This table lists the genetic markers in the first column and the recombination fractions across the top of the table. Each cell of the column shows the LOD score for an individual marker tested for linkage to the Zmax1 (LRP5) gene at the recombination fraction shown in the first row. For example, the peak LOD score of 7.66 occurs at marker D11S970, which is within the interval defined by haplotype analysis.

The kindred described have several features of great interest, notably that their bones, while very dense, have an absolutely normal shape. The outer dimensions of the skeletons of the HBM-affected individuals are normal, and, while medullary cavities are present, there is no interference with hematopoiesis. The HBM affected members seem to be resistant to fracture, and there are no neurologic symptoms, and no symptoms of impairment of any organ or system function in the members examined. HBM-affected members of the kindred live to advanced age without undue illness or disability. Furthermore, the HBM phenotype matches no other bone disorders such as osteoporosis, osteoporosis pseudoglioma, Engelmann's disease, Ribbing's disease, hyperphosphatasemia, Van Buchem's disease, melorheostosis, osteopetrosis, pycnodysostosis, sclerostenosis, osteopoikilosis, acromegaly, Paget's disease, fibrous dysplasia, tubular stenosis, osteogenesis imperfecta, hypoparathyroidism, pseudohypoparathyroidism, pseudopseudohypoparathyroidism, primary and secondary hyperparathyroidism and associated syndromes, hypercalciuria, medullary. carcinoma of the thyroid gland, osteomalacia and other diseases. Clearly, the HBM locus in this family has a very powerful and substantial role in regulating bone density, and its identification is an important step in understanding the pathway(s) that regulate bone density and the pathogenesis of diseases such as osteoporosis.

In addition, older individuals carrying the HBM gene, and therefore expression of the HBM protein, do not show loss of

TABLE 5

| Marker | 0.0 | 0.05 | 0.1 | 0.15 | 0.2 | 0.25 | 0.3 | 0.35 | 0.4 |
| --- | --- | --- | --- | --- | --- | --- | --- | --- | --- |
| D11S935 | infinity | 0.39 | 0.49 | 0.47 | 0.41 | 0.33 | 0.25 | 0.17 | 0.10 |
| D11S1313 | infinity | 2.64 | 2.86 | 2.80 | 2.59 | 2.30 | 1.93 | 1.49 | 1.00 |
| D11S987 | infinity | 5.49 | 5.18 | 4.70 | 4.13 | 3.49 | 2.79 | 2.03 | 1.26 |
| D11S4113 | 4.35 | 3.99 | 3.62 | 3.24 | 2.83 | 2.40 | 1.94 | 1.46 | 0.97 |
| D11S1337 | 2.29 | 2.06 | 1.81 | 1.55 | 1.27 | 0.99 | 0.70 | 0.42 | 0.18 |
| D11S970 | 7.66 | 6.99 | 6.29 | 5.56 | 4.79 | 3.99 | 3.15 | 2.30 | 1.44 |
| D11S4136 | 6.34 | 5.79 | 5.22 | 4.61 | 3.98 | 3.30 | 2.59 | 1.85 | 1.11 |
| D11S4139 | 6.80 | 6.28 | 5.73 | 5.13 | 4.50 | 3.84 | 3.13 | 2.38 | 1.59 |
| FGF3 | 0.59 | 3.23 | 3.15 | 2.91 | 2.61 | 2.25 | 1.84 | 1.40 | 0.92 |
| D11S1314 | 6.96 | 6.49 | 5.94 | 5.34 | 4.69 | 4.01 | 3.27 | 2.49 | 1.67 |
| D11S937 | infinity | 4.98 | 4.86 | 4.52 | 4.06 | 3.51 | 2.88 | 2.20 | 1.47 |

A single nucleotide polymorphism (SNP) further defines the HBM region. This SNP is termed SNP_Contig033-6 and is located 25 kb centromeric to the genetic marker GTC_HBM_Marker_5. This SNP is telomeric to the genetic marker GTC_HBM_Marker_7. SNP_Contig033-6 is present in HBM-affected individual 0113. However, the HBM-affected individual 9019, who is the son of 0113, does not carry this SNP. Therefore, this indicates that the crossover is centromeric to this SNP. The primer sequence for the genetic markers GTC_HBM_Marker_5 and GTC_HBM_Marker_7 is shown in Table 6 below.

bone mass characteristic of normal individuals. In other words, the HBM gene is a suppressor of osteoporosis. In essence, individuals carrying the HBM gene are dosed with the HBM protein, and, as a result, do not develop osteoporosis. This in vivo observation is strong evidence that treatment of normal individuals with the HBM gene or protein, or a fragment thereof, will ameliorate osteoporosis.

6. Physical Mapping

To provide reagents for the cloning and characterization of the HBM locus, the genetic mapping data described above

TABLE 6

| Marker | Primer (Forward) | Primer (Reverse) |
| --- | --- | --- |
| GTC_HBM_Marker_5 | TTTTGGGTACACAATTCAGTCG (SEQ ID NO:63) | AAAACTGTGGGTGCTTCTGG (SEQ ID NO:65) |
| GTC_HBM_Marker_7 | GTGATTGAGCCAATCCTGAGA (SEQ ID NO:64) | TGAGCCAAATAAACCCCTTCT (SEQ ID NO:66) | were used to construct a physical map of the region containing Zmax1 (LRP5) on chromosome 11q13.3. The physical map consists of an ordered set of molecular landmarks, and a set of BAC clones that contain the Zmax1 (LRP5) gene region from chromosome 11q13.3.

Various publicly available mapping resources were utilized to identify existing STS markers (Olson et al., 1989 *Science* 245:1434-5) in the HBM region. Resources included the GDB, the Whitehead Institute Genome Center, dbSTS and dbEST (NCBI), 11 db, the University of Texas Southwestern GESTEC, the Stanford Human Genome Center, and several literature references (Courseaux et al., 1997 *Genomics* 40: 13-23; Courseaux et al., 1996 *Genomics* 37: 354-65; Guru et al., 1997 *Genomics* 42: 436-45; Hosoda et al., 1997 *Genes Cells* 2: 345-57; James et al., 1994 *Nat. Genet.* 8: 70-76; Kitamura et al., 1997 *DNA Research,* 4: 281-9; Lemmens et al., 1997 *Genomics* 44: 94-100; and Smith et al., 1997 *Genome Res.* 7: 835-42). Maps were integrated manually to identify markers mapping to the region containing Zmax1 (LRP5).

Primers for existing STSs were obtained from the GDB or literature references are listed in Table 6 below. Thus, Table 7 shows the STS markers used to prepare the physical map of the Zmax1 (LRP5) gene region.

TABLE 7

HBM STS Table

| STS Name | Locus Name | Type | GDB Access # | Size (kb) | SEQ ID NO: Forward Primer | SEQ ID NO: Reverse Primer | Gene Name |
|---|---|---|---|---|---|---|---|
| ACTN3 | | Gene | GDB: 197568 | 0.164 | 67: CTGGACTACGTGGCCTTCTC | 68: TTCAGAGCACTTGGCTGG | Actinin, alpha 3-skeletal muscle |
| PC-B/PC-Y | | Gene | GDB: 197884 | 0.125 | 69: CTCAGTGCCATGAAGATGGA | 70: CAAGATCACTCGATCTCCAGG | Pyruvate Carboxylase |
| | D11S2161E | Gene | | 0.322 | 71: GTTTCAGGAGACTCAGAGTC | 72: TTCTGCAGGTTGCTGTTGAG | Adenosine Receptor (A2) Gene |
| ADRBK1 | | Gene | GDB: 4590179 | 0.117 | 73: TTATTGTGATTTCCCGTGGC | 74: GCCCTCGTGTCCTGACTTCAGG | Beta-adrenergic receptor kinase |
| PSANK3 | | GENE | | 0.259 | 75: GAGAAAGAAATAAGGGACC | 76: TGCTTTGTAAAGCACTGAGA | sim. to Human endogenous retrovirus mRNA long terminal repeat |
| PP1(1/2)/PP1(2/2) | | Gene | GDB: 197566 | 0.208 | 77: GAAGTACGGGCAGTTCAGTGGCCT | 78: ATACACCAAGGTCCATGTTCCCGT | Protein phosphatase 1, catalytic subunit, alpha isoform |
| GSTP1.PCR1 | | Gene | GDB: 270065 | 0.19 | 79: AGCCTGGGCCACAGCGTGAGACTACGT | 80: TCCCGGAGCTTGCAC ACCCGCTTCACA | Glutathione S-transferase p1 |
| NDUFV1 | | Gene | | 0.521 | 81: CATGTGCCACCTCATTCAT | 82: CAAGATTCTGTAGCTTCTGG | NADH dehydrogenase (ubiquinone) flavoprotein 1 (51 kD) |
| PSANK2 | | Gene | | 0.157 | 83: CAGAGAAGTCAAGGACTTG | 84: ATCCTCTCCACATCCCACACT | Aldehyde Dehydrogenase 8 (ALDH8) |
| PSANK1 | | EST | | 0.3 | 85: CAAGGCTAAAAGACGAAAAA | 86: TCAGGAGCATTTCATCTTTT | Human ribosomal protein L37 (PSANK1) pseudogene. |
| UT5620 | D11S1917 | MSAT | GDB: 314521 | 0.211 | 87: AAGTCGAGGCTGCAAGGAG | 88: GCCCTGTGTTCCTTTCAGTA | |
| AFM289ya9 | D11S1337 | MSAT | GDB: 199805 | 0.287 | 89: AAGGTGTGAGGATCACTGG | 90: AGCTCATGGGGCTATT | |
| GALN | | Gene | | 0.322 | 91: GCTTCTCCGAGTGTATCAAC | 92: ATGGCAGAGGACTTAGAACA | Preprogalanin (GAL1) |
| pM551 | D11S97 | VNTR | GDB: 177850 | | 93: GATCACGCGAACTTCCTCTCGGCTC | 94: TCCACATTGAGGACTGTGGGAACG | |
| BCL1(1)/BCL1(2) | | Gene | | 0.205 | 95: GCTAATCACAGTCTAACCGA | 96: TTGCACTGTCTTGGATGCA | B-cell CLL/lymphoma 1 - Cyclin D1 (PRAD1 gene) |
| CCND1 | | Gene | GDB: 4590141 | 0.248 | 97: CAGGCCGCAAAGGACATGCACACGGC | 98: CAGGCCGCAAAGGACATGCACACGGC | Cyclin D1 |
| FGF4 | | Gene | GDB: 4590113 | 0.549 | 99: CACCGATGAGTGCACGTTCAAGGAG | 100: CAGACAGAGATGCTCCACGCCATAC | Fibroblast growth factor 4 |

TABLE 7-continued

HBM STS Table

| STS Name | Locus Name | Type | GDB Access # | Size (kb) | SEQ ID NO: Forward Primer | SEQ ID NO: Reverse Primer | Gene Name |
|---|---|---|---|---|---|---|---|
| FGF3_PCR1 | | Gene | GDB: 188627 | 0.161 | 101: TTTCTGGGTGTGTCTGAAT | 102: ACACAGTTGCTCTAAAGT | Fibroblast growth factor 3 |
| AFM164ZF12 | D11S913 | MSAT | GDB: 188151 | 0.22 | 103: CATTTGGGAAATCCAGAAGA | 104: TAGGTGTCTTATTTTTTGTTGCTTC | |
| AFMA190YD5 | | MSAT | GDB: 1222329 | 0.275 | 105: GACATACCATGAACAACTATAGAGG | 106: CAACCCATACCAGGGATAAG | |
| SHGC-15295 | D11S4689 | STS | GDB: 740600 | 0.147 | 107: GAACAAGAGGGTAAGTTGGC | 108: TGAGGACACAGATACTGATGGG | |
| SHGC-3084 | D11S4540 | STS | GDB: 740102 | 0.167 | 109: GAAGTGTTCCCTCTTAAATTCTTG | 110: GAACTATATTGTAGTTAGTGAGGAG | |
| SHGC-14407 | D11S4664 | STS | GDB: 740516 | 0.158 | 111: CCTGTAACCCCCAGTCC | 112: TCTTGCTTCCTAAGTTTCTCGG | |
| SHGC-10946 | D11S4327 | Gene | GDB: 674522 | 0.311 | 113: ACTCCATCCACCTCATCACTG | 114: TGCTGTTTGCCTCATCTGAC | Choline Kinase |
| S515 | D11S703 | STS | GDB: 196290 | 0.166 | 115: GTGGACAGGCATAGCTGAGG | 116: TGTTCACTCTTCTGCCTGCAG | |
| AFMA147XD10 | D11S1889 | MSAT | GDB: 307895 | 0.183 | 117: AGCTGGACTCTCACAGAATG | 118: CAAGAGGCTGGTAGAAGGTG | |
| AFMA131YE5 | D11S987 | MSAT | GDB: 195002 | 0.082 | 119: GACTCCAGTCTGGGCAATAAAAGC | 120: GGTGGCAGCATGACCCTCTAAAG | |
| AFMb358xa9 | D11S4178 | MSAT | GDB: 611922 | 0.237 | 121: CAGGCCCAGTCTTG | 122: CGTGTCCAGATGAAAGTG | |
| AFMa272yb5 | D11S4113 | MSAT | GDB: 608115 | 0.218 | 123: ACCTCACGGTGTAATCCC | 124: CTTGAAGCCCATCTTTGC | |
| WI-17803 | | EST | GDB: 4581644 | 0.15 | 125: TATTTGCAAAGCTTGAGACTTCT | 126: AATCACTCTGCTTTGTTGCC | |
| SGC31923 | | EST | GDB: 4578606 | 0.126 | 127: ACTTTATTGTCAGCGTGGGC | 128: ACTCCCTCGATGGCTTCC | |
| WI-7741 | D11S4364 | GENE | GDB: 677652 | 0.324 | 129: GAGCAGGGAGAGAAGGC | 130: CCCAACTGGCTTGTTTTTATTG | Transformation-sensitive protein IEF SSP 3521 |
| SGC35223 | | EST | GDB: 4582598 | 0.13 | 131: AGCCACTTTATTGTTATTTGATGC | 132: AAGAGTGAACAAAGCAAACATACC | ZNF162-splicing factor 1 |
| WI-16754 | | EST | GDB: 4578377 | 0.15 | 133: GTGGAGTGTGGGATTGGG | 134: TACTGTTCTTGATAAGTATGTCGGC | |
| WI-6315 | D11S4418 | EST | GDB: 678804 | 0.224 | 135: ATGCTTTTTGCATGATTCTAATTATT | 136: TCCCCCAAAAGAATGTAAACG | |
| WI-16915 | | EST | GDB: 4584055 | 0.125 | 137: CTGGCTTCCTTGTGTGCTG | 138: ATCACCCCAGGCCAGGGAT | Mitogen inducible gene (MIG-2) |
| SGC30608 | | EST | | 0.128 | 139: TCAGAAGCAGAACTGTTTTAACA | 140: CCTGCTTGAAAGTTCTAGAGCC | |
| WI-17663 | | EST | GDB: 4583346 | 0.126 | 141: CAAGCGCGGGTTTTATTGAAA | 142: GATGCCAGGACCATGAC | |
| WI-6383 | | Gene | GDB: 1222237 | 0.199 | 143: GCATATAGAAACAATTTATTGCCG | 144: CTCTGAAGCAGGACCAGAG | Human tat interactive |

TABLE 7-continued

HBM STS Table

| STS Name | Locus Name | Type | GDB Access # | Size (kb) | SEQ ID NO: Forward Primer | SEQ ID NO: Reverse Primer | Gene Name |
|---|---|---|---|---|---|---|---|
| SGC31567 | | Gene | GDB: 4578432 | 0.207 | 145: CTACCACACCACCAGGC | 146: CAAGCGAAAGCTGCCTTC | Calcium activated neutral protease large subunit, muCANP, calpain protein (TIP60) |
| SGC30658 | | EST | GDB: 4584037 | 0.15 | 147: GTTGTCTTGACTTCAGTCTGTC | 148: TTTTCCTTCAACAATCACTACTCC | |
| SGC34590 | | EST | | 0.13 | 149: GCGTGGGATATAGAGGTCA | 150: TACGTGGCCAAGAAGCTAGG | |
| SGC33927 | | EST | GDB: 4582382 | 0.15 | 151: TAATATATCCCCAGTCTAAGGCAT | 152: AGCTTGCAGATGAGCCC | |
| WI-8671 | | EST | GDB: 1222235 | 0.124 | 153: TGGTTTTAAACCTTTAATGAGAAAA | 154: TGTTGATCTATACCCTGTTTCCG | |
| WI-12334 | | EST | GDB: 1222257 | 0.127 | 155: AATTATTTAAAAGAGGAAAGGCA | 156: TGGCTGTGAACTTCCTCTGA | |
| WI-18402 | | EST | GDB: 4581874 | 0.113 | 157: GGTTACAGAAAAACATTTGAGAGAT | 158: TGAGCTTAGTTCCCTTCTCTG | |
| WI-18671 | | EST | GDB: 4584947 | 0.131 | 159: TTGAAAAACATTTATTTCACCG | 160: TCTGCGGCTGTTGGATT | Hlark |
| WI-12856 | | EST | GDB: 4576606 | 0.209 | 161: TTGAAAAACCATTTATTTCACCG | 162: TGTTCTCTTCTCCCAGCAGG | Hlark |
| SGC33767 | | EST | GDB: 4581106 | 0.15 | 163: CTTTATTGAAAACATTGAGTGCA | 164: TTGTCAAATTCCCCCAAAA | |
| AFM343YB5 | | MSAT | GDB: 1222332 | 0.181 | 165: AAACCACGACCNCCAA | 166: CCCTGGAAAGGTAAGATGCT | |
| SGC33744 | | EST | GDB: 4575826 | 0.15 | 167: CTTTTTGGTAGAGACAAGGTCTCA | 168: TATCTGTCTGTAGTGCTTCAAATGT | |
| SGC32272 | | EST | GDB: 4581592 | 0.15 | 169: GACGAGGTGATTCAGGGC | 170: ACTGAAGAACTCTTGTCT | |
| SGC34148 | | EST | GDB: 4583084 | 0.1 | 171: CAGATAAAAAGAGTCACTATGGCTCA | 172: CACTTCTCCCACTTTGTCCC | |
| WI-18546 | | EST | GDB: 4574598 | 0.133 | 173: TTATTGATAAGCATTAGTGAACCCC | 174: TGGCAAGTTAGGACACAGTCA | Human 1.1 kb mRNA upregulated in retinoic acid treated HL-60 neutrophillic cells |
| SGC31103 | | EST | GDB: 4567265 | 0.1 | 175: CTATGCCCAGAGATGAACAGG | 176: TCCACTAAGGGCTATGTCGC | |
| SGC30028 | | Gene | GDB: 4580505 | 0.128 | 177: GCCAGCTTTATTGAGTAAACTTCC | 178: CACTGAGACTACAAGTGGTGG | Human pyruvate carboxylase precursor |
| WI-2875 | D11S4407 | STS | GDB: 678546 | 0.125 | 179: CATCCCAACCATCACTCAGT | 180: GGGGACTAGCTTACAGATTTGA | |
| SGC36985 | | Gene | GDB: 4577182 | 0.223 | 181: AGACTACATTTTGGAACCAGTGG | 182: TGAAAGGATATTTATAGCCTGGA | LAP-interacting protein 1b |

TABLE 7-continued

HBM STS Table

| STS Name | Locus Name | Type | GDB Access # | Size (kb) | SEQ ID NO: Forward Primer | SEQ ID NO: Reverse Primer | Gene Name |
|---|---|---|---|---|---|---|---|
| GCT16807 | D11S4270 | STS | GDB: 626245 | 0.137 | 183: GAAGGTTTTGTCCCTCGATC | 184: TGAGGGTTGGGAAGATCATA | |
| WI-6504 | D11S3974 | EST | GDB: 588142 | 0.174 | 185: CCTTCATAGCCACACCCG | 186: CAGCTAACTGTTGACATGCCA | |
| SGC31049 | | EST | GDB: 4580093 | 0.15 | 187: TCTTTACTGTGCTTACAACTTTCCT | 188: CAACAGTGCAGTCGGTATCG | |
| TIGR-AD02117 | | EST | GDB: 12222193 | 0.199 | 189: AGATCAGCAAGCAGATAG | 190: CATTCCACATGGATAGAC | NDUFV1 |
| WI-5996 | D11S2382 | EST | GDB: 458683 | 0.1 | 191: CATACCTATGAGGTGTGCTACAGG | 192: GCATTTTCTCATCATCCTTGC | amplaxin (EMS1) |
| WI-16987 | | EST | GDB: 4575848 | 0.15 | 193: TTACAGCCACCAAGGTTTCC | 194: AGTTGTGTGTGCCAGGTTGA | Nuclear mitotic apparatus protein 1, NUMA |
| SGC31912 | | EST | GDB: 4567868 | 0.101 | 195: CACTGTGTATCTCATTAACTGTGAGG | 196: TTTGATTTTGTGTCTCCCAAA | |
| WI-13500 | | EST | GDB: 4577893 | 0.15 | 197: CCCCACTCCCACTTTTATT | 198: CCAGTCACCTTTACTAGTCCTTG | |
| CHLC.GAAT1B01.P7933 | D11S971 | MSAT | GDB: 684255 | 0.103 | 199: AGGACACAGCCTGCATCTAG | 200: ACCAGGCATTGCACTAAAAG | |
| SGC35519 | | Gene | GDB: 4577180 | 0.134 | 201: GATGGGGTCACACTAACCTGTCA | 202: ACATTTATATTGGACATGCAACC | LAR-interacting protein 1a mRNA |
| WI-11974 | | EST | GDB: 1222255 | 0.108 | 203: AGCATCTTTAATGTGTCAGGCA | 204: ATGTGCTGGGCTGGAAAG | Carnitine palmitoyl transferase I |
| WI-15244 | | Gene | GDB: 4574740 | 0.108 | 205: TCACATTCAAAAATCGGCAA | 206: CTGCCTGTGTGGTGTCGC | Beta-adrenergic receptor kinase 1, ADRB1 |
| WI-17496 | | EST | GDB: 4583336 | 0.131 | 207: TCTTTTATTTCTCAGTACAAAGCCA | 208: GACCTCCTGTGACACACG | |
| WI-9159 | D11S4381 | EST | GDB: 678144 | 0.111 | 209: CCACCAAATTATTTATAGTTCTGCG | 210: GTAAGATTCTCCACTGTTGCACC | FGF4 |
| WI-4232 | | STS | GDB: 1222250 | 0.175 | 211: CCTATAATGGGCTGACCAA | 212: ACTCCTCATGTGAAGTCACCG | |
| SHGC-4167 | | EST | GDB: 4566789 | 0.161 | 213: CAGTGTGCACGTTTTCATTT | 214: CAGCATCTTCAGCACTTACC | |
| WI-14303 | | EST | GDB: 4576938 | 0.15 | 215: CTGCATTTATTATGAGAATCAACAG | 216: TGCTGCTGGGAGTCAGAGTC | |
| WI-16597 | | EST | GDB: 4585666 | 0.13 | 217: CAGGGCACTGAGATACACTTACC | 218: AAGGATCAAGCAGGCATTTG | |
| RC2951CATTFOR/ RC2951CATTREV | D11S970 | MSAT | GDB: 191084 | 0.15 | 219: ACACATCTCTTCTGTGTCCCC | 220: TGAACCCTGGAGGCAGAG | Human DNA helicase gen (SMBP2) |

TABLE 7-continued

HBM STS Table

| STS Name | Locus Name | Type | GDB Access # | Size (kb) | SEQ ID NO: Forward Primer | SEQ ID NO: Reverse Primer | Gene Name |
|---|---|---|---|---|---|---|---|
| UT979 | D11S1296 | MSAT | GDB: 198525 | 0.362 | 221: CATTCCCAGTTTGCAGAC | 222: GTGCTGGGATTACAGGTGT | |
| 1281/1282 | D11S1959E | EST | GDB: 335216 | 0.07 | 223: GCAGAGAAGTCCTGTTAGCC | 224: CCATGCTAGAAGCACAAC | |
| D11S468 | D11S468 | STS | | 0.096 | 225: AGTGTCGGGCAGGACCTCTG | 226: CAGACAGATAGCCCTGGGTTC | |
| D11S668 | D11S668 | STS | GDB: 179349 | 0.143 | 227: TCCCTCATCCCCTTGTCTGT | 228: AGCCCCCTGGGGATAATC | |
| RH18048 | | Gene | GDB: 4572853 | 0.188 | 229: GATGCTTACCTACCACGGC | 230: AGGATTCCTATCTGGGCTATG | Aldehyde dehydrogenase (ALDH8) |
| IGHMBP2 | | Gene | GDB: 4590087 | 0.699 | 231: TGGCAGACCATGCTCCGCCT | 232: GAGAAGGCCGGGAGGCTCTG | Human DNA helicase gen (SMBP2) |
| NUMA | | Gene | GDB: 4590244 | 0.277 | 233: CTCCATCACACACCAGATTTGAGGCT | 234: GGGTGTGAGCTGCTGCTGAAGG | Nuclear mitotic apparatus protein 1, NUMA |
| KRN1 | | Gene | GDB: 4590232 | 0.228 | 235: AGTGGGAAACCTCAGTAGCTCCCGA | 236: CAGTTTGGCTCAGACATATGGGGGCA | High sulphur keratin, KRN |
| Cdaiff06 | D11S2302E | EST | GDB: 455887 | 0.091 | 237: CATTAAGTAGTGGGGGACAG | 238: CAAAGCGACAGTGAGTTAGGG | |
| RH10753 | | Gene | GDB: 4563588 | 0.194 | 239: GGAGTAGACCATGATTACTG | 240: CATGGTCTATTTATTCTCG | protein phosphatase 2A, PP2A |
| EMS1 | | Gene | GDB: 459016 | 0.64 | 241: CGCCCTGGATCCTCACACTACA | 242: GGGCATCAGGGGATGGGTAGA | Amplaxin |
| SHGC-11098 | DXS9736 | Gene | GDB: 737674 | 0.137 | 243: GCTCCTATCTGTGTTTTGAATGG | 244: CCGTGGCATAAGATAAGTAAACG | Androgen Receptor |
| INPPL1 | | Gene | GDB: 4590093 | 0.382 | 245: CTTGGAGCGCTATGAGGAGGGC | 246: ATGGCAACTGACCTTCCGTCCTG | 51C protein, Inositol polyphosphate phosphatase-like 1 |
| RH18051 | | EST | GDB: 4572859 | 0.195 | 247: TTGGAGTCACAGGGGC | 248: CAGCACTATCCTTGGGG | NOF1 |
| Cdalcc11 | D11S2297E | EST | GDB: 445869 | 0.1 | 249: AACAAAGTGCTTAGCACCTG | 250: GATGAGGACCACTGGTGAC | |
| 1249/1250 | D11S1957E | EST | GDB: 335210 | 0.247 | 251: TTTTCCAATAATGTGACTTC | 252: CAATCCCAACCGTAACAGGC | |
| NDUFV1 | D11S2245E | EST | GDB: 445695 | | 253: CTTGATCTCGCCCAGGAAC | 254: GCTCGCTGAAGGATGAAGAC | NDUFV1 |
| AFMb032zg5 | D11S4136 | MSAT | GDB: 609546 | 0.19 | 255: GAATCGCTTGAACCCAG | 256: CCAAGTGGTCTTAACG | |
| AFMa059xg9 | D11S4196 | MSAT | GDB: 614025 | 0.2 | 257: GAACGTTNTTCATGTAGGCGT | 258: TAATGGTCGCTGTCCC | |
| Cda17c12 | D11S2288E | EST | GDB: 445842 | 0.158 | 259: AGGGAAAATGTATGTGGGAG | 260: GCAGTGTGTGAAGGCAGG | |

TABLE 7-continued

HBM STS Table

| STS Name | Locus Name | Type | GDB Access # | Size (kb) | SEQ ID NO: Forward Primer | SEQ ID NO: Reverse Primer | Gene Name |
|---|---|---|---|---|---|---|---|
| SHGC-1364 | D11S951E | EST | GDB: 4562765 | 0.137 | 261: AGTGGACAAATGAGGAAACAGG | 262: CCAACACAGTTTGCTCACATGCC | |
| RH17410 | | EST | GDB: 4571587 | 0.126 | 263: TGACATCTTTGCATTATGGC | 264: AGTTATCCCACCTGATACCG | |
| RH17414 | | EST | GDB: 4571595 | 0.121 | 265: AGCTCTTGCTTCTCAGTCCA | 266: CAAAAGTTGTTTCTGTGTTTGTTC | |
| RH1770 | | EST | GDB: 4572301 | 0.267 | 267: GCCTCTCAAAGTAGTTGGAACC | 268: TGTGTATCCATAGTGCAAAACAG | |
| SEA | | EST | GDB: 4590169 | 0.13 | 269: CTCAAGGCCAGGCATCACT | 270: GGACTCTTCCATGCCAGTG | S13 avain erythroblastosis oncogene homolog |
| RH10689 | | EST | GDB: 4563460 | 0.107 | 271: AATGATGATCTCAACTCTG | 272: ACTGAAGAACTCTTGTCCT | |
| TIGR-A006P20 | | EST | GDB: 4587692 | 0.236 | 273: GACATCTGTTAGTCTCATAATTC | 274: GGTAACAGTGTCTTGCTT | |
| TIGR-A007D15 | | Gene | GDB: 4588398 | 0.24 | 275: CATTGTACAAAACAGGAAGAG | 276: ATCCTAGTTTCCTCTCCTT | Menin gene (MEN1) |
| TIGR-A008K14 | | EST | GDB: 4588882 | 0.143 | 277: GTAAATGAGAACAGACAAATGA | 278: CTATTGGATGTGATATGTTATGG | |
| TIGR-A008K11 | | EST | GDB: 4589094 | 0.203 | 279: AAGTAGAAACAAAATGAGGGAC | 280: CCTACCCCAAGTAACAG | |
| TIGR-A008P15 | | EST | GDB: 4589662 | 0.182 | 281: ACTTCCTATAAATGAGGTGAG | 282: GAGGAGCTTCAAGAGAA | |
| TIGR-A008T11 | | EST | GDB: 4589278 | 0.138 | 283: CATACTCCTAGACTCAAGGAATC | 284: GAATGATGTACATGAATTCTCTTG | |
| TIGR-A008U48 | | EST | GDB: 4589364 | 0.107 | 285: GTGTTGAGGAGAAAAGCACT | 286: CTCCCAGTAGTCACATTCC | |
| TIGR-A008X45 | | EST | GDB: 4589838 | 0.242 | 287: CAAGTTACAAATAACTTAAGCCG | 288: CAAGACCCTATCTCTACAAAAAC | |
| SHGC-11839 | D11S4611 | Gene | GDB: 740339 | 0.151 | 289: TTTATTAGAAGTGACTCTTGGCCC | 290: GACTACCTGCCCTCAGCTTG | Folate receptor 2 (FBP2) |
| NIB1242 | D11S4929E | EST | GDB: 3888276 | 0.149 | 291: TTCTCATGTACAAAGCGGTC | 292: CCACTGGCTTCTCTCTTTT | cGMP-stimulated 3',5'-cyclic nucleotide phosphodiesterase PDE2A3 (PDE2A) |
| SHGC-13599 | D22S1553 | Gene | GDB: 737558 | 0.147 | 293: CACCAGAAGGTTGGGGTG | 294: ACTATTACGACATGAACGCGG | Macrophage Migration Inhibitory factor |
| SHGC-11867 | D11S4331 | Gene | GDB: 674684 | 0.14 | 295: CTCTGCTGGATGACCCC | 296: TTGCCTTTCTTGAAACTTAATTCC | P2U Purinoceptor |
| SHGC-15349 | D12S2124 | EST | GDB: 740819 | 0.141 | 297: TCACAGCCTTCAGTCAGGG | 298: ACATGCTGTGGCACCATG | |
| Bda84aD5 | D11S2235E | EST | GDB: 445662 | 0.095 | 299: CCTGAGCTACTGCCACAG | 300: CCCTGACTTGGACAGTGTCC | |

TABLE 7-continued

HBM STS Table

| STS Name | Locus Name | Type | GDB Access # | Size (kb) | SEQ ID NO: Forward Primer | SEQ ID NO: Reverse Primer | Gene Name |
|---|---|---|---|---|---|---|---|
| Bda99d07 | D11S2238E | EST | GDB: 445674 | 0.09 | 301: TCAGAGTCACTCCTGCCC | 302: CAAATTCAAGCTCATCCAGACC | |
| folr1 | | Gene | GDB: 197840 | 0.3 | 303: CGGCATTTCATCCAGGAC | 304: GGTGTAGGAGGTGCGACAAT | Folate receptor 2 (FBP3) |
| NIB1738 | D11S4284 | EST | GDB: 626260 | 0.173 | 305: TTCCATTATTGAGCACCTG | 306: CTTAAGCCACTGTGTTTTGG | |
| WI-7351 | D11S4433 | Gene | GDB: 679143 | 0.324 | 307: CCTTCCTACACCTGCAAAAGC | 308: TGGAAGAACCCCAGAGGAC | Folate receptor 3 (FBP3) |
| WI-14325 | | EST | GDB: 4578507 | 0.132 | 309: AAAGCACAAAAGTAACAGCAACA | 310: GTGTGTGGGCCACAATATTG | |
| WI-15192 | | EST | GDB: 4575806 | 0.15 | 311: AGAGCACCTTTCCTCAGCAC | 312: AGAATCTCATCACAGGGGCG | |
| WI-17872 | | EST | GDB: 4577492 | 0.141 | 313: AAAAAGGACAGTGTCTAAAATTTGA | 314: AATTGTTTTTGTTTGTTTTTGAGT | |
| SHGC-30732 | | EST | GDB: 4567830 | 0.105 | 315: GATTTAGGGAGTACAGTGCGG | 316: GGGGACAAATTATACTTTATTCAGG | |
| stSG4288 | | EST | GDB: 4566057 | 0.123 | 317: CCATCATCATATTGGTGTGACC | 318: TGGCGCCCAAGAAGAAG | |
| WI-13814 | | EST | GDB: 4579290 | 0.15 | 319: TTAAGATGCCATTAAACTCATGA | 320: CCAAGGAGGATGACCAAGTGG | (DRES9) |
| WI-14122 | | Gene | GDB: 4576114 | 0.126 | 321: CCATCTCTTTTATCCAGGGTTGG | 322: CTCTGTGCAAGTAAGCATCTTACA | Human VEGF related factor isoform VRF186 precursor (VRF) |
| 2729/2730 | D11S4057 | EST | GDB: 596509 | 0.118 | 323: CGACTGTGTATTTCCACAG | 324: AGAAGCCCATATCAATGCAC | |
| SHGC-31329 | | EST | GDB: 4567386 | 0.15 | 325: AGCTTAAAGTAGGACAACCATGG | 326: GGATGCTTCACTCCAGAAG | |
| SGC33858 | | EST | GDB: 4578600 | 0.127 | 327: TGTTGTTTATTTCCACCTGCC | 328: AGAGTGGCTGCAGGCCAG | |
| WI-12191 | | EST | GDB: 1222208 | 0.15 | 329: TTTTTTTTTTTTACACGAATTTGAGG | 330: TGAGGAAGTAAAAACAGGTCATC | |
| WI-13701 | | EST | GDB: 4574892 | 0.15 | 331: ATGAAATCTTAAGCAGAATCCCA | 332: CACAGAGTCCCAGGGTCTGT | |
| WI-14069 | | EST | GDB: 4584373 | 0.15 | 333: AAAGGCCTTTATTTATCTCTCTG | 334: GCCTCAGAGCTCAGCTACC | |
| WI-14272 | | EST | GDB: 4578525 | 0.125 | 335: GCTTCTAAGTCTTAGAGTCTAGAGT CAGCTGG | 336: AGCCACAGTCAGCCTACC | |
| WI-17347 | | EST | GDB: 4578523 | 0.127 | 337: TTGGTTAAAATGATGCCCAGA | 338: TGGTCCCACTCACATCCC | |
| stSG1561 | | EST | GDB: 4564415 | 0.215 | 339: ACACAGCATGCCAGGAGAG | 340: ATCCCTGTGCTTAGGTGG | |
| stSG1938 | | EST | GDB: 4564568 | 0.137 | 341: GATGGAAGTAGCTCCTCTCGG | 342: GGAAGGCCAGCAAGTACTACC | |

TABLE 7-continued

HBM STS Table

| STS Name | Locus Name | Type | GDB Access # | Size (kb) | SEQ ID NO: Forward Primer | SEQ ID NO: Reverse Primer | Gene Name |
|---|---|---|---|---|---|---|---|
| stSG2759 | | EST | GDB: 4565137 | 0.141 | 343: CCGGTTGCTTGAAAGATG | 344: GAAGTGTCTCTGTTGGGGA | |
| RH97 | | EST | GDB: 4559690 | 0.17 | 345: TTACAGGCATGAGTCACTACGC | 346: ACCACTCTCAGACAGCCCTTACA | |
| stSG4794 | | EST | GDB: 4573113 | 0.141 | 347: CCCTCCCTCCACACACAC | 348: GCTCACTGAACTTTCAGGGC | |
| stSG4957 | | EST | GDB: 4569051 | 0.171 | 349: AGATACGGGCAAAAACACTGG | 350: GTTGAAATATAGAGCAGGGCCC | |
| stSG4974 | | EST | GDB: 4569063 | 0.166 | 351: TTCTGAGGTCAGGGCTGTCT | 352: AGCTTGAAAATCTCGTGTCA | |
| stSG8144 | | EST | GDB: 4573137 | 0.17 | 353: ACTCAGTCCCTCCCACCC | 354: TCCTCTCACTCCTTCCCAGA | |
| stSG9275 | | EST | GDB: 4569999 | 0.19 | 355: GTGATCACGGCTCAACCTG | 356: TGGAGGACTGCGCTTGAGCC | |
| SHGC-10667 | D11S4583 | Gene | GDB: 740246 | 0.277 | 357: CTGCAGCTGCCTCAGTTTC | 358: TCAAAAGTGCTGGTGACAGC | Human protein kinase (MLK-3) |
| SHGC-11930 | | Gene | GDB: 1231223 | 0.21 | 359: ATTTCCAGAGCCAGCTCAAA | 360: CTTTAATGTTGTGATGACACAAAGC | FGF3 |
| SHGC-32786 | | EST | GDB: 4567878 | 0.125 | 361: GATCATGCACTGTTGACCAC | 362: TACATTTGAAACATTAAAACTGA | |
| FKBP2 | | Gene | | 0.064 | 363: AACTGAGCTGTAACCAGACTGGGA | 364: TGGAACAGTCTCGTCCTGATGG | FK506-Binding Protein Precursor (FKBP-13) |
| WI-13116 | | EST | GDB: 4585099 | 0.202 | 365: TTATCCCTTTATTGTTTCTCCTTTG | 366: TGGTCACCTGTATTATTGCTAGG | |
| MDU1 | | Gene | GDB: 4590064 | 0.859 | 367: TCTTCAAAGCCTCTCTGCAGTACC | 368: CTCATCTCCAACCTGTCTAACC | 4F2 Cell-Surface Antigen Heavy Chain (4F2HC) |
| S453 | D11S579 | STS | GDB: 196276 | 0.108 | 369: GTGGCTGCAGTCAATGCTAAGACAC | 370: CAGCAGAGACAATGGCGTAAGTCC | |
| STS1-cSRL-112e11 | D11S3866 | STS | GDB: 547681 | 0.135 | 371: CTGATTGAGAACCAGAACAG | 372: TAAAGCCCTATAACCTCTCC | |
| STS1-cSRL-44a3 | D11S3830 | STS | GDB: 547609 | 0.118 | 373: TAGTAAGGGACCTTCACCAG | 374: AGATGTTTGGTATGACTTGG | |
| STS1-cSRL-31b12 | D11S2439 | STS | GDB: 459728 | 0.123 | 375: GATGATTAAACTCTCCTGGC | 376: GAGACAGCTAAGCACTCATG | |
| cSRL-419 | D11S1137 | STS | GDB: 197824 | 0.196 | 377: GAGGTGGTGGGCACCTGTA | 378: AGAGGGGATGGAACACACCTT | Folate receptor 2 (FBP2) |
| SHGC-10323 | D11S4351 | Gene | GDB: 676135 | 0.141 | 379: GACCAGAGTCTGCCCAGAAG | 380: TCCCCAGCTCTATCCCAAC | Collagen binding protein 2, colligin-2 gene (CBP2) |
| WI-9219 | | Gene | GDB: 678179 | 0.1 | 381: GGAGGGGATGGACAAGTCTGA | 382: GTCCAGTCGCTGACTATCC | Retinal outer segment membrane protein 1, ROM1 |

TABLE 7-continued

HBM STS Table

| STS Name | Locus Name | Type | GDB Access # | Size (kb) | SEQ ID NO: Forward Primer | SEQ ID NO: Reverse Primer | Gene Name |
|---|---|---|---|---|---|---|---|
| GTC_ZNF | | Gene | | 0.172 | 383: TCAAAACACAGTCATCTCCA | 384: GCAAAGGCTTTACCATATTG | ZNF126 |
| AFMa152yh1 | D11S4087 | MSAT | GDB: 603797 | 0.158 | 385: GCTCAGCACCCCCATT | 386: TCCCTGTCGGGAAAC | |
| AFMb331zh5 | D11S4162 | MSAT | GDB: 611241 | 0.263 | 387: GTTCTCCAGAGAGACAGCAC | 388: GAGAGCAACACTATTGCCC | |
| AFMb038yb9 | D11S4139 | MSAT | GDB: 609621 | 0.151 | 389: TATAGACTTCAGCCCTGCTGC | 390: CCTCTGTAGGATGCAGTTGG | |
| AFM212xe3 | D11S1314 | MSAT | GDB: 199292 | 0.209 | 391: TTGCTACGCACTCCTCTACT | 392: GTGAAGGCAGGAAATGTGAC | |
| WI-18813 | | EST | | 0.13 | 393: ATCCTAGACCAGAGAGGCCC | 394: CTCCCCCTGGTCCAGTTATT | Serine/threonine kinase |
| WI-19549 | | EST | | 0.252 | 395: AACTTTCATTTGCCAAGGGA | 396: AGCAGATCTGCTCTTGCGAT | |
| WI-20154 | | EST | | 0.25 | 397: bACAGTTGTCATCGGTAGGCA | 398: AAAAGTATGAATGGGATGGAGC | |
| WI-22393 | | EST | GDB: 4583084 | 0.142 | 399: GTGCAGGTGGCCGTTTATTT | 400: CCCTATATCTCCGTGTGCTCC | DRES9 |
| WI-7587 | | EST | GDB: 1223732 | 0.274 | 401: GCTCTAGTGGGAAACCTCAGG | 402: GAATTCCAGGCTCTTGCTTG | Ultra high-sulphur keratin protein (KRN1) |
| EST455579 | | EST | | 0.273 | 403: GGTTTGGTCTCAAAGGCAAA | 404: CCAGTACATGGTGGTCACCA | |
| WI-21134 | | EST | | 0.293 | 405: GCTGCCTTGGAATTTCTGTT | 406: GTGCTGTGTGGGGAAAG | Fas-associating death domain-containing protein, FADD |
| WI-21698 | | EST | GDB: 740192 | 0.25 | 407: ATTCAAGCTCATCCAGACCC | 408: GGACTGGCCTTTGAAACTC | |
| SHGC-7373 | D11S4567 | STS | | 0.225 | 409: ATATTGACCGTGCACAAATACG | 410: AGACCTGGGAAAAGTGGAGAA | |
| SHGC-36533 | | STS | | 0.125 | 411: ATTGGCCAGTGGAAAATGCTT | 412: TTAATCTTTTGTCAACTTCCTGATT | |
| ARIX | | Gene | GDB: 6262613 | 0.242 | 413: tctgtcctccttcaccggaagc | 414: ggataagaaactccgctctgctggtaga | Arix homeo-domain protein, neuroendocrine specific, tx factor |
| CLCLPCR | | Gene | | | 415: TCAGGGCCTGTGTTGCCGCACTCTG | 416: AGCGATGTAAAGGGTACCAGTGCCGAGG | Chloride channel current inducer, ICLN gene |
| B188N21-HL | | STS | | | 417: AGGCATGCAAGCTTCTTA | 418: CCCGGAGAGACATCTAT | |

TABLE 7-continued

HBM STS Table

| STS Name | Locus Name | Type | GDB Access # | Size (kb) | SEQ ID NO: Forward Primer | SEQ ID NO: Reverse Primer | Gene Name |
|---|---|---|---|---|---|---|---|
| B234C17-HR | | STS | | | 419: TGGTAAGCACAGAAATGC | 420: AATGGATGGGGATTATT | |
| B235G10-HR | | STS | | | 421: CTGGACGTTATGTCTGCC | 422: AGAGGCCCAGTCACAGAT | |
| B247F23-HR | | STS | | | 423: ATCACTCTGAACTGCCACT | 424: CCCTTCTGTTTTTCTGTTTT | |
| B337H24-HL | | STS | | | 425: CAAGCTTTGAAGGAAGAG | 426: TAGGACGTTAAGTGAGGAC | |
| B337L5-HL | | STS | | | 427: GCTCTCGCAGTGGGTAAAA | 428: ACTCTCCAAGACTGTGCG | |
| B382N10-HR | | STS | | | 429: CCCTTTCTGAGGCAAGAT | 430: GACCACCTGGGAGAGAAC | |
| B1211-HR | | STS | | | 431: CGCTATGAGTCCCATCTG | 432: GATCAGCTGCAATGAAGG | |
| B180D17-HR | | STS | | | 433: TTGAGTACACGGGGTGAC | 434: CGCAGGACTGAAAGATGA | |
| B236E6-HR | | STS | | | 435: ACCTGTCTCCTCCTCCTGG | 436: TGCTTTTCTTCTGTGGGA | |
| B278E22-HR | | STS | | | 437: ATGACCAGCAAGCATTGT | 438: GTACTGGGATTACAGGCG | |
| B313F21-HR | | STS | | | 439: GCAGAAGGTCCTTTGGAT | 440: TTTGCAGGATTCATGCTT | |
| B337H24-HR | | STS | | | 441: CGACATTCTTTTTCTGGAGG | 442: ACCTTTGCATGTTGGTTTT | |
| B358H9-HR | | STS | | | 443: GCACTTTTCCTTCCTTCC | 444: TGCTTTGCTTTCTTCTGG | |
| B148N18-HL | | STS | | | 445: ACAGCTCCAGAGAGAAGGA | 446: GCAGTCACTTGAAACCAGA | |
| B172N12-HL | | STS | | | 447: AGGCATCAAGCTTTCCTT | 448: GGTTTAGAGAACCGAGCC | |
| B172N12-HR | | STS | | | 449: GTGGTGCTGCAAGTTACC | 450: GGAATCCCTTTCTTTCCA | |
| B215J11-HR | | STS | | | 451: GACCATTTGTTACGCAGC | 452: GATGGGTGTGAATGAACAA | |
| B223E5-HR | | STS | | | 453: CTCAAGCTTCTTGTTCATGC | 454: GCTGTGAGTGTCTTGGCT | |
| B312B3-HR | | STS | | | 455: TACAGAAAACCGCAGCTC | 456: GCCACCAAAGGAAAGATT | |
| B328G19-HL | | STS | | | 457: AAAAGGAGGGAATCATGG | 458: TCACTTAGCAGGAGGCAG | |
| B328G19-HR | | STS | | | 459: CTGAGCATCCGATGAGAC | 460: GTGCAAAATGACCAGCTT | |
| B329I10-HL | | STS | | | 461: TCTAACCCTTACTGGGC | 462: TCCTCAACTGGGAATGA | |
| B320I10-HR | | STS | | | 463: TTACACAGGACCAGGGA | 464: ATCTCCCCACTCAGAAG | |
| B368G19-HL | | STS | | | 465: GTCCACGGGCTTTATTCT | 466: TGAGCATAAATTTCATTAGCTG | |

TABLE 7-continued

HBM STS Table

| STS Name | Locus Name | Type | GDB Access # | Size (kb) | SEQ ID NO: Forward Primer | SEQ ID NO: Reverse Primer | Gene Name |
|---|---|---|---|---|---|---|---|
| B368G19-HR | | STS | | | 467: GGAAGAGCAAAATAAATCCA | 468: GGTGCACAGAATTGTTCAT | |
| B36F16-HL | | STS | | | 469: AGCACGCTTATTTCATGG | 470: GTAACACCAGCAGGGACA | |
| B250K11-HR | | STS | | | 471: TCCTGCTGCATTATGGAT | 472: GGGGGTGAGAAGTAGGAA | |
| B338D17-HR | | STS | | | 473: ATGGGGATTAAATACGGG | 474: AGCTAGCATTGGGCTCTT | |
| B268I23-HL | | STS | | | 475: CTGAGGAGAAGAGGCTGG | 476: CGCCTTACAAGGCAAGTA | |
| B286I23-HR | | STS | | | 477: AGGATGCTTGTGTAGGGTT | 478: CACAAGTGTCTGGAAGGC | |
| B371E15-HR | | STS | | | 479: GGTCTCAGGAGCCCTTTA | 480: ACATGCCACTCTTCTCACTAA | |
| B312F21-HL | | STS | | | 481: ACTTAACCAAGGATGGGG | 482: CAACCCACGAGCATAAGA | |
| B338D17-HL | | STS | | | 483: TAGGCTCTGCACTCTTGG | 484: ACCCACGGAGTCTCTCTC | |
| B369H19-HL | | STS | | | 485: TAAAGGCGGTGAAGTGAG | 486: CTACCGCTCTCCTAGGCT | |
| B369H19-HR | | STS | | | 487: TGGGGCCAGATAATCTT | 488: CTGGTGTTTGGTGGTGTT | |
| B444N11-HR | | STS | | | 489: AAGGAAGAGGTCACCAGG | 490: CACAAATTCCATTTCCCA | |
| B269L23-HL | | STS | | | 491: TCAATAGGTGATCCAACATTT | 492: AAAGTCCCACAAAGGGTC | |
| B250K11-HL | | STS | | | 493: GGGTAGGGGGATCTTTTT | 494: TGTGGAACATTCATTGGC | |
| B269L23-HR | | STS | | | 495: GTCCTGGGAAAGATGAA | 496: TCAAAGCTCTCCCATAA | |
| B364H4-HL | | STS | | | 497: TCTTTCGCTGTACTTGGC | 498: TGGGAGGTCAGAGTGATG | |
| B364H4-HR | | STS | | | 499: GGACAGTGTATGTGTTGGG | 500: AGGCAGCTGTTTTTGTGA | |
| B473O3-HR | | STS | | | 501: CTTCTTGAGTCCCGTGTG | 502: CAACCGAGAATCCTAGC | |
| B180D17-HL | | STS | | | 503: GCTGGGAGAGAATCACAA | 504: GCTTTGCAGAAGAGACCA | |
| B200E21-HL | | STS | | | 505: ACGCTGTCAGGTCACACT | 506: GGAGGATGCTCAGGTGAT | |
| B200E21-HR | | STS | | | 507: TAGGGGGATCTTTTTCCA | 508: GAGCAATTTGAAAAGCCA | |
| B14L15-HR | | STS | | | 509: ATGGTCCAGTCCTCCTGT | 510: ATAGAGCACCCCATCTCC | |
| B442P6-HR | | STS | | | 511: AACATTGCTGTTAGCCCA | 512: GCAATCGAAACAGCATTC | |

TABLE 7-continued

HBM STS Table

| STS Name | Locus Name | Type | GDB Access # | Size (kb) | SEQ ID NO: Forward Primer | SEQ ID NO: Reverse Primer | Gene Name |
|---|---|---|---|---|---|---|---|
| B188N21-HR | | STS | | | 513: ATGAGTTGGCAGCTGAAG | 514: AATGAAGTCTTGCCTCC | |
| GTC-ARRB1 | | Gene | | 0.067 | 515: GAGGAGAAGATCCACAAGCG | 516: TCTCTGGGCATACTGAACC | Beta-arrestin-1 |
| B508A5-HL | | STS | | | 517: CTGAGCTTTTGGCACTGT | 518: CTGCTAGTGACAGCAGG | |
| B36F16-HR | | STS | | | 519: TGTATGAGTCTGGAGGGTGT | 520: ACACCTGGCTGAGGAAAT | |
| B117N18-HL | | STS | | | 521: GCAGGGGACGTGATAATA | 522: TTTTGCTTCCTACCATGC | |
| B14L15-HL | | STS | | | 523: AAAATTGTGAGCACCTCC | 524: TTTATATTTAAAGTGGCTTTGTT | |
| B21K22-HL | | STS | | | 525: GTGCAAAGCCCACAGTAT | 526: AGGAAAATGCAAGAGCAG | |
| B21K22-HR | | STS | | | 527: CCACTGCAATTGCATACTTTG | 528: TCTGGGTCCAGTCTGCTA | |
| B223E5-HL | | STS | | | 529: AGATTTTGGGAGTAGTCA | 530: GCGCTCCAAGCAATTCTC | |
| B278E22-HL | | STS | | | 531: CAGCCCCAAAGTAGTCA | 532: GAATCATCCAATCCACGA | |
| B444M11-HL | | STS | | | 533: AGCCTCCAGGTGACTACC | 534: GAAGGACATGGTCAGCAG | |
| B543O19-HR | | STS | | | 535: ATGCTTTCAGCATTTTCG | 536: TGATCCGTGGTAGGGTTA | |
| B117N18-HR | | STS | | | 537: GTCGGATTGGTTTCACAA | 538: TTTATGGGAATTTCAGCC | |
| B543O19-HL | | STS | | | 539: TTTGAAAAGAACAGAAATGT | 540: GGCTAGTCTTTCCTGAACC | |
| B442P6-HL | | STS | | | 541: CCTTAATGCCCCTGATTC | 542: GCGTTTACAAGCTGAGGA | |
| B367H4-HR | | STS | | | 543: TCAAGCTTGCTTTCTCAA | 544: GTAGCCCAGCAAGTGTCT | |
| B250E21-HR | | STS | | | 545: CCTGGCTGGAGATAGGAT | 546: CTTCCCCTCTGCCTATGT | |
| B250E21-HL | | STS | | | 547: GGCACGTACTTCCTACCA | 548: GGTGCTCTTACAGGCAA | |
| B248C16-HR | | STS | | | 549: ACCCAGGCTGGTGTGT | 550: ACTGAGTTAATTATCACTCCCCT | |
| B248C16-HL | | STS | | | 551: GATGCATTTTGCTTCACC | 552: TCTGTTTTAGAGCTGTGTAGC | |
| B160D8-HR | | STS | | | 553: TCAAGCTTCAAAGAGCAGA | 554: GGAGTACATCCCAGGACC | |
| B539L7-HR | | STS | | | 555: TGGTGCTTTAAATCCAGA | 556: CTCCCTTACTTACTTGCATTG | |
| B47303-HL | | STS | | | 557: TCTTCTCCCAGGGAATCT | 558: TTTATGTCCCCTGAGCAC | |
| AFMa190xd9 | D11S4095 | STS | GDB: 606064 | 0.193 | 559: TCCCTGCTATCTTGAATC | 560: CTTGACTGGGTCCACG | |

TABLE 7-continued

HBM STS Table

| STS Name | Locus Name | Type | GDB Access # | Size (kb) | SEQ ID NO: Forward Primer | SEQ ID NO: Reverse Primer | Gene Name |
|---|---|---|---|---|---|---|---|
| ARRB1(2) | | STS | | | 561: CGAGACCCAGTAGATACCA | 562: CATCCTCCATGCCTTTCAGT | |
| ARRB1(1) | | STS | | | 563: AGTTCCAGAGAACGAGACGC | 564: CTTGTCATCCTCCATGCCTT | |
| P102F3S | | STS | GDB: 6054145 | | 565: GAGCGTGAGAGGTTGAGGAG | 566: AAACAAACTCCAGACGCACC | |
| N172A | | STS | GDB: 6054146 | 0.208 | 567: CTGAACCACTACCTGTATGACCT | 568: CTAACTACTTACTCCTACAGGGCCCT | |
| N60A | | STS | GDB: 6054147 | 0.23 | 569: GAAGCATTTCAATACTTTAACTG | 570: CCACTCCAGTGCACCCAATC | |
| cCI11-44A | | STS | GDB: 6054148 | 0.239 | 571: CTTCTCCTGGCCACTCTGAC | 572: GGTTTACCTTTGAATCCCAGC | |
| CN1677-2A | | STS | GDB: 6054149 | 0.271 | 573: TGAGGATGAATGAGCACATAG | 574: TTTGTGGTCCATTGAGTAGGC | |
| cCI11-524B | | STS | GDB: 6054150 | 0.221 | 575: AGGGGAAGGAATGTGCTTGG | 576: TTCGGCTGAGCGGGCAGTGT | |
| P117F3T | | STS | GDB: 6054151 | 0.168 | 577: ATTGAAGGTCCTCCAAAGAATGCTGCAGC | 578: AGAACGTCAACATATCTTTTGGGGACAC | |
| ARRB1(3) | | Gene | | | 579: TTGTATTTGAGGACTTTGCTCG | 580: CGTACCATCCTCCTCTTCC | |
| B215J11-HL | | STS | | 0.122 | 581: TTTTTGCCTCATCTATGCCC | 582: GGGTGACAGAGCAAGACTCC | |
| B317G1-HR | | STS | | | 583: TTGCTCAAGTTCTCCTGG | 584: ACCTTGTTTTGAGGGGAG | |
| B317G1-HL | | STS | | | 585: CTTGGCTATTTGGACAGC | 586: GGGCATTTACTCACTTGC | |
| B292J18-HR | | STS | | | 587: CTTGTGTCAGTTGTCAGGG | 588: TGGAATTGTTGTGTCTTGG | |
| B10A18-HL | | STS | | | 589: CCAGTTCCACTGACGATGTT | 590: ATGGGCTGTGTTTTCTCAA | |
| B10A18-HR | | STS | | | 591: CTGCCTATCCCTGGACTT | 592: ACTTTGTCCCTAGTGCCC | |
| B527D12-HL | | STS | | | 593: CAACACGTCTGACATCCAT | 594: GGATAGTGCACACCCA | |
| B372J11-HR | | STS | | | 595: TGGGTGGTACTATTGTTCCCAT | 596: AGTTCCAGCCCCCTTACCAG | |
| B372J11-HL | | STS | | | 597: GGCCACTATCATCCCTGTGT | 598: TTTCACATGGAAGAACACG | |
| B37E17-HR(GS) | | STS | | | 599: ACAGTGACACTTAGGGACGGG | 600: TGCCAGGATGGAGATAACAA | |
| B37E17-HL(GS) | | STS | | | 601: CCTGTGGCACACATATCACC | 602: ACAACCAAGAATGGAGCCAC | |
| B34F22-HR(GS) | | STS | | | 603: TGCTGTGTAACAAGTCCCCA | 604: TGAACGGAGGACCTACCAAG | |
| B34F22-HL(GS) | | STS | | | 605: GCAGGGTCCGACTCACTAAG | 606: GCTGTGAGTTCCCTTTACGC | |

TABLE 7-continued

HBM STS Table

| STS Name | Locus Name | Type | GDB Access # | Size (kb) | SEQ ID NO: Forward Primer | SEQ ID NO: Reverse Primer | Gene Name |
|---|---|---|---|---|---|---|---|
| B648P22-HR1 | | STS | | | 607: ACAGTGGGACAAAGACAGG | 608: TACAGGGCACCTCCCAGTAG | |
| B82A4-HR2 | | STS | | | 609: TCTTCTGTTAAGGTTTCCCCC | 610: TGTCTCAAACCTCCCTCTGC | |
| B648P22-HL | | STS | | | 611: AACATATTTCCTCCCCAGCC | 612: CAGTCCCAGCCAATGAGAAC | |
| B82L11-HL(GS) | | STS | | | 613: CTCCTCTGCATGGGAGAATC | 614: AGACCTGGGACCAGTCTGTG | |
| B86J13-HL(GS) | | STS | | | 615: GGGAGACGACTCACAAGAT | 616: TGATGTTGGGAAGATGGTGA | |
| 144A24-HL | | STS | | | 617: CAGGCATCTTCTATGTGCCA | 618: GGGAGGCACAAGTTCTTTCA | |
| B82L11-HR(GS) | | STS | | | 619: ACTTCGTGGCACTGAGTGTG | 620: CCTTTCTTACGATGAGGCA | |
| B86J13-HR(GS) | | STS | | | 621: GGCTGCTGAGCTCTTCTGAT | 622: TGGGTCTCTGCCTGACTT | |
| B82L11-HL2(GS) | | STS | | | 623: TCACCTACTTCCAGCTTCCG | 624: AGACCTGGGACCAGTCTGTG | |
| B82L11-HL3(GS) | | STS | | | 625: CTCCTCTGCATGGGAGAATC | 626: AATTCAGGAGACCTGGGACC | |

Novel STSs were developed either from publicly available genomic sequence or from sequence-derived BAC insert ends. Primers were chosen using a script which automatically performs vector and repetitive sequence masking using Cross_match (P. Green, Univ. of Washington) and subsequent primer picking using Primer3 (Rozen, Skaletsky (1996, 1997).

Polymerase chain reaction (PCR) conditions for each primer pair were initially optimized with respect to $MgCl_2$ concentration. The standard buffer was 10 mM Tris-HCl (pH 8.3), 50 mM KCl, $MgCl_2$, 0.2 mM each dNTP, 0.2 µM each primer, 2.7 ng/µl human DNA, 0.25 units of AmpliTaq (Perkin Elmer) and $MgCl_2$ concentrations of 1.0 mM, 1.5 mM, 2.0 mM or 2.4 mM. Cycling conditions included an initial denaturation at 94° C. for 2 minutes followed by 40 cycles at 94° C. for 15 seconds, 55° C. for 25 seconds, and 72° C. for 25 seconds followed by a final extension at 72° C. for 3 minutes. Depending on the results from the initial round of optimization the conditions were further optimized if necessary. Variables included increasing the annealing temperature to 58° C. or 60° C., increasing the cycle number to 42 and the annealing and extension times to 30 seconds, and using AmpliTaq™ Gold (Perkin Elmer).

BAC clones (Kim et al., 1996 *Genomics* 32: 213-8; and Shizuya et al., 1992 *Proc. Natl. Acad. Sci. USA* 89: 8794-7) containing STS markers of interest were obtained by PCR-based screening of DNA pools from a total human BAC library purchased from Research Genetics. DNA pools derived from library plates 1-596 were used corresponding to nine genomic equivalents of human DNA. The initial screening process involved PCR reactions of individual markers against superpools, i.e., a mixture of DNA derived from all BAC clones from eight 384-well library plates. For each positive superpool, plate (8), row (16) and column (24), pools were screened to identify a unique library address. PCR products were electrophoresed in 2% agarose gels (Sigma) containing 0.5 µg/ml ethidium bromide in 1×TBE at 150 volts for 45 min. The electrophoresis units used were the Model A3-1 systems from Owl Scientific Products. Typically, gels contained 10 tiers of lanes with 50 wells/tier. Molecular weight markers (100 bp ladder, Life Technologies, Bethesda, Md.) were loaded at both ends of the gel. Images of the gels were captured with a Kodak DC40 CCD camera and processed with Kodak 1D software. The gel data were exported as tab delimited text files; names of the files included information about the library screened, the gel image files and the marker screened. These data were automatically imported using a customized Perl script into Filemaker™ PRO (Claris Corp.) databases for data storage and analysis. In cases where incomplete or ambiguous clone address information was obtained, additional experiments were performed to recover a unique, complete library address.

Recovery of clonal BAC cultures from the library involved streaking out a sample from the library well onto LB agar (Maniatis et al., *Molecular Cloning: A Laboratory Manual*, Cold Spring Harbor Laboratory, Cold Spring Harbor, N.Y. (1982)) containing 12.5 µg/ml chloramphenicol (Sigma). Two individual colonies and a portion of the initial streak quadrant were tested with appropriate STS markers by colony PCR for verification. Positive clones were stored in LB broth containing 12.5 µg/ml chloramphenicol and 15% glycerol at −70° C.

Several different types of DNA preparation methods were used for isolation of BAC DNA. The manual alkaline lysis miniprep protocol listed below (Maniatis et al., 1982) was successfully used for most applications, i.e., restriction mapping, CHEF gel analysis, FISH mapping, but was not successfully reproducible by endsequencing. The Autogen and Qiagen protocols were used specifically for BAC DNA preparation for endsequencing purposes.

Bacteria were grown in 15 ml Terrific Broth containing 12.5 µg/ml chloramphenicol in a 50 ml conical tube at 37° C. for 20 hrs with shaking at 300 rpm. The cultures were centrifuged in a Sorvall RT 6000 D at 3000 rpm (~1800×g) at 4° C. for 15 min. The supernatant was then aspirated as completely as possible. In some cases, cell pellets were frozen at −20° C. at this step for up to 2 weeks. The pellet was then vortexed to homogenize the cells and minimize clumping. 250 µl of P1 solution (50 mM glucose, 15 mM Tris-HCl, pH 8, 10 mM EDTA, and 100 µg/ml RNase A) was added and the mixture pipetted up and down to mix. The mixture was then transferred to a 2 ml Eppendorf tube. 350 µl of P2 solution (0.2 N NaOH, 1% SDS) was then added, the mixture mixed gently and incubated for 5 min at room temperature. 350 µl of P3 solution (3 M KOAc, pH 5.5) was added and the mixture mixed gently until a white precipitate formed. The solution was incubated on ice for 5 min and then centrifuged at 4° C. in a microfuge for 10 min. The supernatant was transferred carefully (avoiding the white precipitate) to a fresh 2 ml Eppendorf tube, and 0.9 ml of isopropanol was added, the solution mixed and left on ice for 5 min. The samples were centrifuged for 10 min, and the supernatant removed carefully. Pellets were washed in 70% ethanol and air dried for 5 min. Pellets were resuspended in 200 µl of TE8 (10 mM Tris-HCl, pH 8.0, 1.0 mM EDTA), and RNase A (Boehringer Mannheim) added to 100 µg/ml. Samples were incubated at 37° C. for 30 min, then precipitated by addition of $C_2H_3O_2Na.3H_2O$ to 0.5 M and 2 volumes of ethanol. Samples were centrifuged for 10 min, and the pellets washed with 70% ethanol followed by air drying and dissolving in 50 µl TE8. Typical yields for this DNA prep were 3-5 µg/15 ml bacterial culture. Ten to 15 µl were used for HindIII restriction analysis; 5 µl was used for NotI digestion and clone insert sizing by CHEF gel electrophoresis.

BACs were inoculated into 15 ml of 2×LB Broth containing 12.5 µg/ml chloramphenicol in a 50 ml conical tube. Four tubes were inoculated for each clone. Cultures were grown overnight (~16 hr) at 37° C. with vigorous shaking (>300 rpm). Standard conditions for BAC DNA isolation were followed as recommended by the Autogen 740 manufacturer. 3 ml samples of culture were placed into Autogen tubes for a total of 60 ml or 20 tubes per clone. Samples were dissolved finally in 100 µl TE8 with 15 seconds of shaking as part of the Autogen protocol. After the Autogen protocol was finished DNA solutions were transferred from each individual tube and pooled into a 2 ml Eppendorf tube. Tubes with large amounts of debris (carry over from the pelleting debris step) were avoided. The tubes were then rinsed with 0.5 ml of TE8 successively and this solution added to the pooled material. DNA solutions were stored at 4° C.; clumping tended to occur upon freezing at −20° C. This DNA was either used directly for restriction mapping, CHEF gel analysis or FISH mapping or was further purified as described below for use in endsequencing reactions.

The volume of DNA solutions was adjusted to 2 ml with TE8, samples were then mixed gently and heated at 65° C. for 10 min. The DNA solutions were then centrifuged at 4° C. for 5 min and the supernatants transferred to a 15 ml conical tube. The NaCl concentration was then adjusted to 0.75 M (~0.3 ml of 5 M NaCl to the 2 ml sample). The total volume was then adjusted to 6 ml with Qiagen column equilibration buffer (Buffer QBT). The supernatant containing the DNA was then applied to the column and allowed to enter by gravity flow. Columns were washed twice with 10 ml of Qiagen Buffer QC.

Bound DNA was then eluted with four separate 1 ml aliquots of Buffer QF kept at 65° C. DNA was precipitated with 0.7 volumes of isopropanol (~2.8 ml). Each sample was then transferred to 4 individual 2.2 ml Eppendorf tubes and incubated at room temperature for 2 hr or overnight. Samples were centrifuged in a microfuge for 10 min. at 4° C. The supernatant was removed carefully and 1 ml of 70% ethanol was added. Samples were centrifuged again and because the DNA pellets were often loose at this stage, the supernatant removed carefully. Samples were centrifuged again to concentrate remaining liquid which was removed with a micropipet tip. DNA pellets were then dried in a desiccator for 10 min. 20 µl of sterile distilled and deionized $H_2O$ was added to each tube which was then placed at 4° C. overnight. The four 20 µl samples for each clone were pooled and the tubes rinsed with another 20 µl of sterile distilled and deionized $H_2O$ for a final volume of 100 µl. Samples were then heated at 65° C. for 5 min. and then mixed gently. Typical yields were 2-5 µg/60 ml culture as assessed by NotI digestion and comparison with uncut lambda DNA.

3 ml of LB Broth containing 12.5 µg/ml of chloramphenicol was dispensed into autoclaved Autogen tubes. A single tube was used for each clone. For inoculation, glycerol stocks were removed from −70° C. storage and placed on dry ice. A small portion of the glycerol stock was removed from the original tube with a sterile toothpick and transferred into the Autogen tube; the toothpick was left in the Autogen tube for at least two minutes before discarding. After inoculation the tubes were covered with tape making sure the seal was tight. When all samples were inoculated, the tube units were transferred into an Autogen rack holder and placed into a rotary shaker at 37° C. for 16-17 hours at 250 rpm. Following growth, standard conditions for BAC DNA preparation, as defined by the manufacturer, were used to program the Autogen. Samples were not dissolved in TE8 as part of the program and DNA pellets were left dry. When the program was complete, the tubes were removed from the output tray and 30 µl of sterile distilled and deionized $H_2O$ was added directly to the bottom of the tube. The tubes were then gently shaken for 2-5 seconds and then covered with parafilm and incubated at room temperature for 1-3 hours. DNA samples were then transferred to an Eppendorf tube and used either directly for sequencing or stored at 4° C. for later use.

7. BAC Clone Characterization for Physical Mapping

DNA samples prepared either by manual alkaline lysis or the Autogen protocol were digested with HindIII for analysis of restriction fragment sizes. This data were used to compare the extent of overlap among clones. Typically 1-2 µg were used for each reaction. Reaction mixtures included: 1×Buffer 2 (New England Biolabs), 0.1 mg/ml bovine serum albumin (New England Biolabs), 50 µg/ml RNase A (Boehringer Mannheim), and 20 units of HindIII (New England Biolabs) in a final volume of 25 µl. Digestions were incubated at 37° C. for 4-6 hours. BAC DNA was also digested with NotI for estimation of insert size by CHEF gel analysis (see below). Reaction conditions were identical to those for HindIII except that 20 units of NotI were used. Six µl of 6× Ficoll loading buffer containing bromphenol blue and xylene cyanol was added prior to electrophoresis.

HindIII digests were analyzed on 0.6% agarose (Seakem, FMC Bioproducts) in 1×TBE containing 0.5 µg/ml ethidium bromide. Gels (20 cm×25 cm) were electrophoresed in a Model A4 electrophoresis unit (Owl Scientific) at 50 volts for 20-24 hrs. Molecular weight size markers included undigested lambda DNA, HindIII digested lambda DNA, and HaeIII digested _X174 DNA. Molecular weight markers were heated at 65° C. for 2 min prior to loading the gel. Images were captured with a Kodak DC40 CCD camera and analyzed with Kodak 1D software.

NotI digests were analyzed on a CHEF DRII (BioRad) electrophoresis unit according to the manufacturer's recommendations. Briefly, 1% agarose gels (BioRad pulsed field grade) were prepared in 0.5×TBE, equilibrated for 30 minutes in the electrophoresis unit at 14° C., and electrophoresed at 6 volts/cm for 14 hrs with circulation. Switching times were ramped from 10 sec to 20 sec. Gels were stained after electrophoresis in 0.5 µg/ml ethidium bromide. Molecular weight markers included undigested lambda DNA, HindIII digested lambda DNA, lambda ladder PFG ladder, and low range PFG marker (all from New England Biolabs).

BAC DNA prepared either by the manual alkaline lysis or Autogen protocols were labeled for FISH analysis using a Bioprime labeling kit (BioRad) according to the manufacturer's recommendation with minor modifications. Approximately 200 ng of DNA was used for each 50 µl reaction. 3 µl were analyzed on a 2% agarose gel to determine the extent of labeling. Reactions were purified using a Sephadex G50 spin column prior to in situ hybridization. Metaphase FISH was preformed as described (Ma et al., 1996 *Cytogenet. Cell Genet.*, 74: 266-71).

8. BAC Endsequencing

The sequencing of BAC insert ends utilized DNA prepared by either of the two methods described above. The DYEnamic energy transfer primers and Dynamic Direct cycle sequencing kits from Amersham were used for sequencing reactions. Ready made sequencing mix including the M13-40 forward sequencing primer was used (Catalog #US79730) for the T7 BAC vector terminus; ready made sequencing mix (Catalog #US79530) was mixed with the M13-28 reverse sequencing primer (Catalog #US79339) for the SP6 BAC vector terminus. The sequencing reaction mixes included one of the four fluorescently labeled dye-primers, one of the four dideoxy termination mixes, dNTPs, reaction buffer, and Thermosequenase. For each BAC DNA sample, 3 µl of the BAC DNA sample was aliquoted to 4 PCR strip tubes. 2 µl of one of the four dye primer/termination mix combinations was then added to each of the four tubes. The tubes were then sealed and centrifuged briefly prior to PCR. Thermocycling conditions involved a 1 minute denaturation at 95° C., 15 second annealing at 45° C., and extension for 1 minute at 70° C. for 35 total cycles. After cycling the plates were centrifuged briefly to collect all the liquid to the bottom of the tubes. 5 µl of sterile distilled and deionized $H_2O$ was then added into each tube, the plates sealed and centrifuged briefly again. The four samples for each BAC were then pooled together. DNA was then precipitated by adding 1.5 µl of 7.5 M $NH_4OAc$ and 100 µl of −20° C. 100% ethanol to each tube. Samples were mixed by pipetting up and down once. The plates were then sealed and incubated on ice for 10 minutes. Plates were centrifuged in a table topHaraeus centrifuge at 4000 rpm (3,290× g) for 30 minutes at 4° C. to recover the DNA. The supernatant was removed and excess liquid blotted onto paper towels. Pellets were washed by adding 100 µl of −20° C. 70% ethanol into each tube and re-centrifuging at 4000 rpm (3,290×g) for 10 minutes at 4° C. The supernatant was removed and excess liquid again removed by blotting on a paper towel. Remaining traces of liquid were removed by placing the plates upside down over a paper towel and centrifuging only until the centrifuge reached 800 rpm. Samples were then air dried at room temperature for 30 min. Tubes were capped and stored dry at −20° C. until electrophoresis. Immediately prior to electrophoresis the DNA was dissolved in 1.5 µl of Amersham loading dye. Plates were then sealed and centrifuged at 2000 rpm (825×g). The plates were then vortexed on a plate shaker for 1-2 minutes. Samples were then recentrifuged at 2000 rpm (825×g) briefly. Samples were then heated at 65° C. for 2 min and immediately placed on ice. Standard gel electrophoresis was performed on ABI 377 fluorescent sequencers according to the manufacturer's recommendation.

9. Sub-cloning and Sequencing of HBM BAC DNA

The physical map of the Zmax1 (LRP5) gene region provides a set of BAC clones that contain within them the Zmax1 (LRP5) gene and the HBM gene. DNA sequencing of several of the BACs from the region has been completed. The DNA sequence data is a unique reagent that includes data that one skilled in the art can use to identify the Zmax1 (LRP5) gene and the HBM gene, or to prepare probes to identify the gene(s), or to identify DNA sequence polymorphisms that identify the gene(s).

BAC DNA was isolated according to one of two protocols, either a Qiagen purification of BAC DNA (Qiagen, Inc. as described in the product literature) or a manual purification which is a modification of the standard alkaline lysis/Cesium Chloride preparation of plasmid DNA (see e.g., Ausubel et al., *Current Protocols in Molecular Biology*, John Wiley & Sons (1997)). Briefly for the manual protocol, cells were pelleted, resuspended in GTE (50 mM glucose, 25 mM Tris-Cl (pH 8), 10 mM EDTA) and lysozyme (50 mg/ml solution), followed by NaOH/SDS (1% SDS/0.2 N NaOH) and then an ice-cold solution of 3 M KOAc (pH 4.5-4.8). RNaseA was added to the filtered supernatant, followed by Proteinase K and 20% SDS. The DNA was then precipitated with isopropanol, dried and resuspended in TE (10 mM Tris, 1 mM EDTA (pH 8.0)). The BAC DNA was further purified by Cesium Chloride density gradient centrifugation (Ausubel et al., 1997).

Following isolation, the BAC DNA was sheared hydrodynamically using an HPLC (Hengen, 1997 *Trends in Biochem. Sci.* 22: 273-4) to an insert size of 2000-3000 bp. After shearing, the DNA was concentrated and separated on a standard 1% agarose gel. A single fraction, corresponding to the approximate size, was excised from the gel and purified by electroelution (Sambrook et al., *Molecular Cloning: A Laboratory Manual*, Cold Spring Harbor Laboratory, Cold Spring, N.Y. (1989)).

The purified DNA fragments were then blunt-ended using T4 DNA polymerase. The blunt-ended DNA was then ligated to unique BstXI-linker adapters (5'-GTCTTCACCACG GGG-3' and 5'-GTGGTGAAGAC-3' in 100-1000 fold molar excess; SEQ ID NOS: 627 and 628 respectively). These linkers were complimentary to the BstXI-cut pMPX vectors (constructed by the inventors), while the overhang was not self-complimentary. Therefore, the linkers would not concatemerize nor would the cut-vector religate itself easily. The linker-adapted inserts were separated from the unincorporated linkers on a 1% agarose gel and purified using GeneClean (BIO 101, Inc.). The linker-adapted insert was then ligated to a modified pBlueScript vector to construct a "shotgun" subclone library. The vector contained an out-of-frame lacZ gene at the cloning site which became in-frame in the event that an adapter-dimer is cloned, allowing these to be avoided by their blue-color.

All subsequent steps were based on sequencing by ABI377 automated DNA sequencing methods. Only major modifications to the protocols are highlighted. Briefly, the library was then transformed into DH5α competent cells (Life Technologies, Bethesda, Md., DH5α transformation protocol). It was assessed by plating onto antibiotic plates containing ampicillin and IPTG/Xgal. The plates were incubated overnight at 37° C. Successful transformants were then used for plating of clones and picking for sequencing. The cultures were grown overnight at 37°. DNA was purified using a silica bead DNA preparation (Ng et al., 1996 *Nucl. Acids Res.* 24: 5045-7) method. In this manner, 25 μg of DNA was obtained per clone.

These purified DNA samples were then sequenced using ABI dye-terminator chemistry. The ABI dye terminator sequence reads were run on ABI377 machines and the data was directly transferred to UNIX machines following lane tracking of the gels. All reads were assembled using PHRAP (P. Green, Abstracts of DOE Human Genome Program Contractor-Grantee Workshop V, Jan. 1996, p. 157) with default parameters and quality scores. The initial assembly was done at 6-fold coverage and yielded an average of 8-15 contigs. Following the initial assembly, missing mates (sequences from clones that only gave one strand reads) were identified and sequenced with ABI technology to allow the identification of additional overlapping contigs. Primers for walking were selected using a Genome Therapeutics program Pick_primer near the ends of the clones to facilitate gap closure. These walks were sequenced using the selected clones and primers. Data were reassembled with PHRAP into sequence contigs.

10. Gene Identification by Computational Methods

Following, assembly of the BAC sequences into contigs, the contigs were subjected to computational analyses to identify coding regions and regions bearing DNA sequence similarity to known genes. This protocol included the following steps.

1. Degap the contigs: the sequence contigs often contain symbols (denoted by a period symbol) that represent locations where the individual ABI sequence reads have insertions or deletions. Prior to automated computational analysis of the contigs, the periods were removed. The original data was maintained for future reference.

2. BAC vector sequences were "masked" within the sequence by using the program cross match by using the program of Phil Green from the University of Washington. Since the shotgun libraries construction detailed above leaves some BAC vector in the shotgun libraries, this program was used to compare the sequence of the BAC contigs to the BAC vector and to mask any vector sequence prior to subsequent steps. Masked sequences were marked by an "X" in the sequence files, and remained inert during subsequent analyses.

3. *E. coli* sequences contaminating the BAC sequences were masked by comparing the BAC contigs to the entire *E. coli* DNA sequence.

4. Repetitive elements known to be common in the human genome were masked using cross match. In this implementation of crossmatch, the BAC sequence was compared to a database of human repetitive elements (Jerzy Jerka, Genetic Information Research Institute, Palo Alto, Calif.). The masked repeats were marked by X and remained inert during subsequent analyses.

5. The location of exons within the sequence was predicted using the MZEF computer program (Zhang, 1997 *Proc. Natl. Acad. Sci USA.* 94: 565-8).

6. The sequence was compared to the publicly available unigene database (National Genter for Biotechnology Information, National Library of Medicine, 38A, 8N905, 8600 Rockville Pike, Bethesda, Md. 20894) using the blastn2 algorithm (Altschul et al., 1997 *Nucl. Acids Res.* 25: 3389-3402). The parameters for this search were: E=0.05, v=50, B=50 (where E is the expected probability score cutoff, V is the number of database entries returned in the reporting of the results, and B is the number of sequence alignments returned in the reporting of the results (Altschul et al., *J. Mol. Biol.*, 215:403-410 (1990)).

7. The sequence was translated into protein for all six reading frames, and the protein sequences were compared to a non-redundant protein database compiled from Genpept Swissprot PIR (National Center for Biotechnology Information, National Library of Medicine, 38A, 8N905, 8600 Rockville Pike, Bethesda, Md. 20894; www.ncbi.nlm.nih.gov). The parameters for this search were E=0.05, V=50, B=50, where E, V, and B are defined as above.

8. The BAC DNA sequence was compared to the database of the cDNA clones derived from direct selection experiments (described below) using blastn2 (Altschul et al., 1997). The parameters for this search were E=0.05, V=250, B=250, where E, V, and B are defined as above.

9. The BAC sequence was compared to the sequences of all other BACs from the HBM region on chromosome 11q12-13 using blastn2 (Altschul et al., 1997). The parameters for this search were E=0.05, V=50, B=50, where E, V, and B are defined as above.

10. The BAC sequence was compared to the sequences derived from the ends of BACs from the HBM region on chromosome 11q12-13 using blastn2 (Altschul et al., 1997). The parameters for this search were E=0.05, V=50, B=50, where E, V, and B are defined as above.

11. The BAC sequence was compared to the GenBank database (National Genter for Biotechnology Information, National Library of Medicine, 38A, 8N905, 8600 Rockville Pike, Bethesda, Md. 20894) using blastn2 (Altschul et al., 1997). The parameters for this search were E=0.05, V50, B=50, where E, V, and B are defined as above.

12. The BAC sequence was compared to the STS division of GenBank database (National Genter for Biotechnology Information, National Library of Medicine, 38A, 8N905, 8600 Rockville Pike, Bethesda, Md. 20894) using blastn2 (Altschul et al., 1997). The parameters for this search were E=0.05, V=50, B=50, where E, V, and B are defined as above.

13. The BAC sequence was compared to the Expressed Sequence (EST) Tag GenBank database (National Center for Biotechnology Information, National Library of Medicine, 38A, 8N905, 8600 Rockville Pike, Bethesda, Md. 20894) using blastn2 (Altschul et al., 1997). The parameters for this search were E=0.05, V=250, B=250, where E, V, and B are defined as above.

11. Gene Identification by Direct cDNA Selection

Primary Tinkered cDNA pools were prepared from bone marrow, calvarial bone, femoral bone, kidney, skeletal muscle, testis and total brain. Poly (A)+RNA was prepared from calvarial and femoral bone tissue (Chomczynski et al., 1987 *Asial. Biochem.* 162: 156-9; and D'Alessio et al., 1987 *Focus* 9: 1-4) and the remainder of the mRNA was purchased from Clontech (Palo Alto, Calif.). In order to generate oligo (dT) and random primed cDNA pools from the same tissue, 2.5 µg mRNA was mixed with oligo(dT) primer in one reaction and 2.5 µg mRNA was mixed with random hexamers in another reaction, and both were converted to first and second strand cDNA according to manufacturers recommendations (Life Technologies, Bethesda, Md.). Paired phosphorylated cDNA linkers (see sequence below) were annealed together by mixing in a 1:1 ratio (10 µg each) incubated at 65° C. for five minutes and allowed to cool to room temperature.

```
Paired linkers oligo 1/2
                                               (SEQ ID NO:12)
OLIGO 1:    5'-CTG AGC GGA ATT CGT GAG ACC-3'

(SEQ ID NO:13)
OLIGO 2:    5'-TTG GTC TCA CGT ATT CCG CTC GA-3'

Paired linkers oligo 3/4
                                               (SEQ ID NO:14)
OLIGO 3:    5'-CTC GAG AAT TCT GGA TCC TC-3'

(SEQ ID NO:15)
OLIGO 4:    5'-TTG AGG ATC CAG AAT TCT CGA G-3'

Paired linkers oligo 5/6
                                               (SEQ ID NO:16)
OLIGO 5:    5'-TGT ATG CGA ATT CGC TGC GCG-3'

(SEQ ID NO:17)
OLIGO 6:    5'-TTC GCG CAG CGA ATT CGC ATA CA-3'

Paired linkers oligo 7/8
                                               (SEQ ID NO:18)
OLIGO 7:    5'-GTC CAC TGA ATT CTC AGT GAG-3'

(SEQ ID NO:19)
OLIGO 8:    5'-TTG TCA CTG AGA ATT CAG TGG AC-3'

Paired linkers oligo 11/12
                                               (SEQ ID NO:20)
OLIGO 11:   5'-GAA TCC GAA TTC CTG GTC AGC-3'

(SEQ ID NO:21)
OLIGO 12:   5'-TTG CTG ACC AGG AAT TCG GAT TC-3'
```

Linkers were ligated to all oligo(dT) and random primed cDNA pools (see below) according to manufacturers instructions (Life Technologies, Bethesda, Md.).

Oligo ½ was ligated to oligo(dT) and random primed cDNA pools prepared from bone marrow. Oligo ¾ was ligated to oligo(dT) and random primed cDNA pools prepared from calvarial bone. Oligo ⅝ was ligated to oligo(dT) and random primed cDNA pools prepared from brain and skeletal muscle. Oligo ⅞ was ligated to oligo(dT) and random primed cDNA pools prepared from kidney. Oligo 11/12 was ligated to oligo(dT) and random primed cDNA pools prepared from femoral bone.

The cDNA pools were evaluated for length distribution by PCR amplification using 1 µl of a 1:1, 1:10, and 1:100 dilution of the ligation reaction, respectively. PCR reactions were performed in a Perkin Elmer 9600, each 25 µl volume reaction contained 1 µl of DNA, 10 mM Tris-HCl (pH 8.3), 50 mM KCl, 1.5 mM $MgCl_2$, 0.001% gelatin, 200 mM each dNTPs, 10 µM primer and 1 unit Taq DNA polymerase (Perkin Elmer) and was amplified under the following, conditions: 30 seconds at 94° C., 30 seconds at 60° C. and 2 minutes at 72° C. for 30 cycles. The length distribution of the amplified cDNA pools were evaluated by electrophoresis on a 1% agarose gel. The PCR reaction that gave the best representation of the random primed and oligo(dT) primed cDNA pools was scaled up so that ~2-3 µg of each cDNA pool was produced. The starting cDNA for the direct selection reaction comprised of 0.5 µg of random primed cDNAs mixed with 0.5 µg of oligo (dT) primed cDNAs.

The DNA from the 54 BACs that were used in the direct cDNA selection procedure was isolated using Nucleobond AX columns as described by the manufacturer (The Nest Group, Inc.).

The BACs were pooled in equimolar amounts and 1 μg of the isolated genomic DNA was labeled with biotin 16-UTTP by nick translation in accordance with the manufacturers instructions (Boehringer Mannheim). The incorporation of the biotin was monitored by methods that could be practiced by one skilled in the art (Del Mastro et al., *Methods in Molecular Biology*, Humana Press Inc., NJ (1996)).

Direct cDNA selection was performed using methods that could be practiced by one skilled in the art (Del Mastro et al., 1996). Briefly, the cDNA pools were multiplexed in two separate reactions: In one reaction cDNA pools from bone marrow, calvarial bone, brain and testis were mixed, and in the other cDNA pools from skeletal muscle, kidney and femoral bone were mixed. Suppression of the repeats, yeast sequences and plasmid in the cDNA pools was performed to a Cot of 20. 100 ng of biotinylated BAC DNA was mixed with the suppressed cDNAs and hybridized in solution to a Cot of 200. The biotinylated DNA and the cognate cDNAs was captured on streptavidin-coated paramagnetic beads. The beads were washed and the primary selected cDNAs were eluted. These cDNAs were PCR amplified and a second round of direct selection was performed. The product of the second round of direct selection is referred to as the secondary selected material. A Galani1 cDNA clone, previously shown to map to 11q12-13 (Evans, 1993 *Genomics* 18: 473-7), was used to monitor enrichment during the two rounds of selection.

The secondary selected material from bone marrow, calvarial bone, femoral bone, kidney, skeletal muscle, testis and total brain was PCR amplified using modified primers of oligos 1, 3, 5, 7 and 11, shown below, and cloned into the UDG vector pAMP10 (Life Technologies, Bethesda, Md.), in accordance with the manufacturer's recommendations.

Modified primer sequences:

| Primer | SEQ ID NO. | Sequence |
| --- | --- | --- |
| Oligo 1 | 22 | 5'-CUA CUA CUA CUA CTG AGC GGA ATT CGT GAG ACC-3' |
| Oligo 3 | 23 | 5'-CUA CUA CUA CUA CTC GAG AAT TCT GGA TCC TC-3' |
| Oligo 5 | 24 | 5'-CUA CUA CUA CUA TGT ATG CGA ATT CGC TGC GCG-3' |
| Oligo 7 | 25 | 5'-CUA CUA CUA CUA GTC CAC TGA ATT CTC AGT GAG-3' |
| Oligo 11 | 26 | 5'-CUA CUA CUA CUA GAA TCC GAA TTC CTG GTC AGC-3' |

The cloned secondary selected material, from each tissue source, was transformed into MAX Efficiency DH5a Competent Cells (Life Technologies, Bethesda, Md.) as recommended by the manufacturer. 384 colonies were picked from each transformed source and arrayed into four 96 well microtiter plates.

All secondarily selected cDNA clones were sequenced using M13 dye primer terminator cycle sequencing kit (Applied Biosystems), and the data collected by the ABI 377 automated fluorescence sequencer (Applied Biosystems).

All sequences were analyzed using the BLASTN, BLASTX and FASTA programs (Altschul et al., 1990 *J. Mol. Biol.* 215: 403-410; and Altschul et al., *Nucl. Acids. Res.* 25: 3389-3402). The cDNA sequences were compared to a database containing sequences derived from human repeats, mitochondrial DNA, ribosomal RNA, *E. coli* DNA to remove background clones from the dataset using the program cross_match. A further round of comparison was also performed using the program BLASTN2 against known genes (GenBank) and the BAC sequences from the HBM region. Those cDNAs that were >90% homologous to these sequences were filed according to the result and the data stored in a database for further analysis. cDNA sequences that were identified but did not have significant similarity to the BAC sequences from the HBM region or were eliminated by cross_match were hybridized to nylon membranes which contained the BACs from the HBM region, to ascertain whether they hybridized to the target.

Hybridization analysis was used to map the cDNA clones to the BAC target that selected them. The BACs that were identified from the HBM region were arrayed and grown into a 96 well microtiter plate. LB agar containing 25 μg/ml kanamycin was poured into 96 well microtiter plate lids. Once the agar had solidified, pre-cut Hybond N+nylon membranes (Amersham) were laid on top of the agar and the BACs were stamped onto the membranes in duplicate using a hand held 96 well replica plater (V&P Scientific, Inc.). The plates were incubated overnight at 37° C. The membranes were processed according to the manufacturers recommendations.

The cDNAs that needed to be mapped by hybridization were PCR amplified using the relevant primer (oligos 1, 3, 5, 7 and 11) that would amplify that clone. For this PCR amplification, the primers were modified to contain a linkered digoxigenin molecule at the 5' of the oligonucleotide. The PCR amplification was performed under the same conditions as described in Preparation of cDNA Pools (above). The PCR products were evaluated for quality and quantity by electrophoresis on a 1% agarose gel by loading 5 μl of the PCR reaction. The nylon membranes containing the stamped BACs were individually pre-hybridized in 50 ml conical tubes containing 10 ml of hybridization solution (5×SSPE, 0.5×Blotto, 2.5% SDS and 1 mM EDTA (pH 8.0)). The 50 ml conical tubes were placed in a rotisserie oven (Robbins Scientific) for 2 hours at 65° C. Twenty-five ng of each cDNA probe was denatured and added into individual 50 ml conical tubes containing the nylon membrane and hybridization solution. The hybridization was performed overnight at 65° C. The filters were washed for 20 minutes at 65° C. in each of the following solutions: 3×SSPE, 0.1% SDS; 1×SSPE, 0.1% SDS and 0.1×SSPE, 0.1% SDS.

The membranes were removed from the 50 ml conical tubes and placed in a dish. Acetate sheets were placed between each membrane to prevent them from sticking to each other. The incubation of the membranes with the Anti-DIG-AP and CDP-Star was performed according to manufacturers recommendations (Boehringer Mannheim). The membranes were wrapped in Saran wrap and exposed to Kodak Bio-Max X-ray film for 1 hour.

12. cDNA Cloning and Expression Analysis

To characterize the expression of the genes identified by direct cDNA selection and genomic DNA sequencing in comparison to the publicly available databases, a series of experiments were performed to further characterize the genes in the HBM region. First, oligonucleotide primers were designed for use in the polymerase chain reaction (PCR) so that portions of a cDNA, EST, or genomic DNA could be amplified from a pool of DNA molecules (a cDNA library) or RNA population (RT-PCR and RACE). The PCR primers were used in a reaction containing genomic DNA to verify that they generated a product of the size predicted based on the genomic (BAC) sequence. A number of cDNA libraries were then examined for the presence of the specific cDNA or EST. The presence of a fragment of a transcription unit in a particular cDNA library indicates a high probability that additional portions of the same transcription unit will be present as well.

A critical piece of data that is required when characterizing novel genes is the length, in nucleotides, of the processed transcript or messenger RNA (mRNA). One skilled in the art primarily determines the length of an mRNA by Northern blot hybridization (Sambrook et al., *Molecular Cloning: A Laboratory Manual*, ColdSpring Harbor Laboratory, Cold Spring Harbor N.Y. (1989)). Groups of ESTs and direct-selected cDNA clones that displayed significant sequence similarity to sequenced BACs in the critical region were grouped for convenience into approximately 30 kilobase units. Within each 30 kilobase unit there were from one up to fifty ESTs and direct-selected cDNA clones which comprised one or more independent transcription units. One or more ESTs or direct-selected cDNAs were used as hybridization probes to determine the length of the mRNA in a variety of tissues, using commercially available reagents (Multiple Tissue Northern blot; Clontech, Palo Alto, Calif.) under conditions recommended by the manufacturer.

Directionally cloned cDNA libraries from femoral bone, and calvarial bone tissue were constructed by methods familiar to one skilled in the art (for example, Soares in *Automated DNA Sequencing and Analysis*, Adams, Fields and Venter, Eds., Academic Press, NY, pages 110-114 (1994)). Bones were initially broken into fragments with a hammer, and the small pieces were frozen in liquid nitrogen and reduced to a powder in a tissue pulverizer (Spectrum Laboratory Products). RNA was extracted from the powdered bone by homogenizing the powdered bone with a standard Acid Guanidinium Thiocyanate-Phenol-Chloroform extraction buffer (e.g., Chomczynski et al., 1987 *Anal. Biochem.* 162: 156-9) using a polytron homogenizer (Brinkman Instruments). Additionally, human brain and lung total RNA was purchased from Clontech. PolyA RNA was isolated from total RNA using dynabeads-dT according to the manufacturer's recommendations (Dynal, Inc.). First strand cDNA synthesis was initiated using an oligonucleotide primer with the sequence: 5'-AACTGGAAGAATTCGCGCTCGAG-GAATTTTTTTTTTTTTTTTT TT-3' (SEQ ID NO:27). This primer introduces a NotI restriction site (underlined) at the 3', end of the cDNA. First and second strand synthesis were performed using the "one-tube" cDNA synthesis kit as described by the manufacturer (Life Technologies, Bethesda, Md.). Double stranded cDNAs were treated with T4 polynucleotide kinase to ensure that the ends of the molecules were blunt (Soares in *Automated DNA Sequencing and Analysis*, Adams, Fields and Venter, Eds., Academic Press, NY, pages 110-114 (1994)), and the blunt ended cDNAs were then size selected by a Biogel column (Huynh et al. in *DNA Cloning*, Vol. 1, Glover, Ed., IRL Press, Oxford, pages 49-78 (1985)) or with a size-sep 400 Sepharose column (Pharmacia, catalog #27-5105-01). Only cDNAs of 400 base pairs or longer were used in subsequent steps. EcoRI adapters (sequence: 5' OH-AATTCGGCACGAG-OH 3' (SEQ ID NO:28), and 5' p-CTCGTGCCG-OH 3' (SEQ ID NO:29)) were then ligated to the double stranded cDNAs by methods familiar to one skilled in the art (Soares 1994). The EcoRI adapters were then removed from the 3' end of the cDNA by digestion with NotI (Soares, 1994). The cDNA was then ligated into the plasmid vector pBluescript® II KS+(Stratagene, La Jolla, Calif.), and the ligated material was transformed into *E. coli* host DH10B or DH12S by electroporation methods familiar to one skilled in the art (Soares, 1994). After growth overnight at 37° C., DNA was recovered from the *E. coli* colonies after scraping the plates by processing as directed for the Mega-prep kit (Qiagen, Chatsworth, Calif.). The quality of the cDNA libraries was estimated by counting a portion of the total numbers of primary transformants and determining the average insert size and the percentage of plasmids with no cDNA insert. Additional cDNA libraries (human total brain, heart, kidney, leukocyte, and fetal brain) were purchased from Life Technologies, Bethesda, Md.

cDNA libraries, both oligo (dT) and random hexamer ($N_6$) primed, were used for isolating cDNA clones transcribed within the HBM region: human bone, human brain, human kidney and human skeletal muscle (all cDNA libraries were made by the inventors, except for skeletal muscle (dT) and kidney (dT) cDNA libraries). Four 10×10 arrays of each of the cDNA libraries were prepared as follows: the cDNA libraries were titered to $2.5 \times 10^6$ using primary transformants. The appropriate volume of frozen stock was used to inoculate 2 L of LB/ampicillin (100 mg/ml). This inoculated liquid culture was aliquoted into 400 tubes of 4 ml each. Each tube contained approximately 5000 cfu. The tubes were incubated at 30° C. overnight with gentle agitation. The cultures were grown to an OD of 0.7-0.9. Frozen stocks were prepared for each of the cultures by allocating 100 μl of culture and 300 μl of 80% glycerol. Stocks were frozen in a dry ice/ethanol bath and stored at −70° C. The remaining culture was DNA prepared using the Qiagen (Chatsworth, Calif.) spin miniprep kit according to the manufacturer's instructions. The DNAs from the 400 cultures were pooled to make 80 column and row pools. The cDNA libraries were determined to contain HBM cDNA clones of interest by PCR. Markers were designed to amplify putative exons. Once a standard PCR optimization was performed and specific cDNA libraries were determined to contain cDNA clones of interest, the markers were used to screen the arrayed library. Positive addresses indicating the presence of cDNA clones were confirmed by a second PCR using the same markers.

Once a cDNA library was identified as likely to contain cDNA clones corresponding to a specific transcript of interest from the HBM region, it was manipulated to isolate the clone or clones containing cDNA inserts identical to the EST or direct-selected cDNA of interest. This was accomplished by a modification of the-standard "colony screening" method (Sambrook et al., *Molecular Cloning: A Laboratory Manual*, Cold Spring Harbor Laboratory, Cold Spring Harbor N.Y. (1989)). Specifically, twenty 150 mn LB+ampicillin agar plates were spread with 20,000 colony forming units (cfu) of cDNA library and the colonies allowed to grow overnight at 37° C. Colonies were transferred to nylon filters (Hybond from Amersham, or equivalent) and duplicates prepared by pressing two filters together essentially as described (Sambrook et al., *Molecular Cloning: A Laboratory Manual*, Cold Spring Harbor Laboratory, Cold Spring Harbor N.Y. (1989)). The "master" plate was then incubated an additional 6-8 hours to allow the colonies to grow back. The DNA from the bacterial colonies was then affixed to the nylon filters by treating the filters sequentially with denaturing solution (0.5 N NaOH, 1.5 M NaCl) for two minutes, neutralization solution (0.5 M Tris-Cl pH 8.0, 1.5 M NaCl) for two minutes (twice). The bacterial colonies were removed from the filters by washing in a solution of 2×SSC/0.1% SDS for one minute while rubbing with tissue paper. The filters were air dried and baked under vacuum at 80° C. for 1-2 hours.

A cDNA hybridization probe was prepared by random hexamer labeling (Fineberg and Vogelstein, *Anal. Biochem.*, 132:6-13 (1983)) or by including gene-specific primers and no random hexamers in the reaction (for small fragments). Specific activity was calculated and was >$5\times10^8$ cpm/$10^8$ µg of cDNA. The colony membranes were then prewashed in 10 mM Tris-Cl pH 8.0, 1 M NaCl, 1 mM EDTA, 0.1% SDS for 30 minutes at 55° C. Following 5 the prewash, the filters were prehybridized in >2 ml/filter of 6×SSC, 50% deionized formamide, 2% SDS, 5×Denhardt's solution, and 100 mg/ml denatured salmon sperm DNA, at 42° C. for 30 minutes. The filters were then transferred to hybridization solution (6×SSC, 2% SDS, 5×Denhardt's, 100 mg/ml denatured salmon sperm DNA) containing denatured $\alpha^{32}$P-dCTP-labeled cDNA probe and incubated at 42° C. for 16-18 hours.

After the 16-18 hour incubation, the filters were washed under constant agitation in 2×SSC, 2% SDS at room temperature for 20 minutes, followed by two washes at 65° C. for 15 minutes each. A second wash was performed in 0.5×SSC, 0.5% SDS for 15 minutes at 65° C. Filters were then wrapped in plastic wrap and exposed to radiographic film for several hours to overnight. After film development, individual colonies on plates were aligned with the autoradiograph so that they could be picked into a 1 ml solution of LB Broth containing ampicillin. After shaking at 37° C. for 1-2 hours, aliquots of the solution were plated on 150 mm plates for secondary screening. Secondary screening was identical to primary screening (above) except that it was performed on plates containing ~250 colonies so that individual colonies could be clearly identified for picking.

After colony screening with radiolabeled probes yielded cDNA clones, the clones were characterized by restriction endonuclease cleavage, PCR, and direct sequencing to confirm the sequence identity between the original probe and the isolated clone. To obtain the full-length cDNA, the novel sequence from the end of the clone identified was used to probe the library again. This process was repeated until the length of the cDNA cloned matches that estimated to be full-length by the northern blot analysis.

RT-PCR was used as another method to isolate full length clones. The cDNA was synthesized and amplified using a "Superscript One Step RT-PCR" kit (Life Technologies, Gaithersburg, Md.). The procedure involved adding 1.5 µg of RNA to the following: 25 µl of reaction mix provided which is a proprietary buffer mix with MgSO$_4$ and dNTP's, 1 µl sense primer (10 µM) and 1 µl anti-sense primer (10 µM), 1 µl reverse transcriptase and Taq DNA polymerase mix provided and autoclaved water to a total reaction mix of 50 µl. The reaction was then placed in a thermocycler for 1 cycle at 50° C. for 15 to 30 minutes, then 94° C. for 15 seconds, 55-60° C. for 30 seconds and 68-72° C. for 1 minute per kilobase of anticipated product and finally 1 cycle of 72° C. for 5-10 minutes. The sample was analyzed on an agarose gel. The product was excised from the gel and purified from the gel (GeneClean, Bio 101). The purified product was cloned in pCTNR (General Contractor DNA Cloning System, 5 Prime-3 Prime, Inc.) and sequenced to verify that the clone was specific to the gene of interest.

Rapid Amplification of cDNA ends (RACE) was performed following the manufacturer's instructions using a Marathon cDNA Amplification Kit (Clontech, Palo Alto, Calif.) as a method for cloning the 5' and 3' ends of candidate genes. cDNA pools were prepared from total RNA by performing first strand synthesis, where a sample of total RNA sample was mixed with a modified oligo (dT) primer, heated to 70° C., cooled on ice and followed by the addition of: 5×first strand buffer, 10 mM dNTP mix, and AMV Reverse Transcriptase (20 U/µl). The tube was incubated at 42° C. for one hour and then the reaction tube was placed on ice. For second strand synthesis, the following components were added directly to the reaction tube: 5×second strand buffer, 10 mM dNTP mix, sterile water, 20×second strand enzyme cocktail and the reaction tube was incubated at 16° C. for 1.5 hours. T4 DNA Polymerase was added to the reaction tube and incubated at 16° C. for 45 minutes. The second-strand synthesis was terminated with the addition of an EDTA/Glycogen mix. The sample was subjected to a phenol/chloroform extraction and an ammonium acetate precipitation. The cDNA pools were checked for quality by analyzing on an agarose gel for size distribution. Marathon cDNA adapters (Clontech) were then ligated onto the cDNA ends. The specific adapters contained priming sites that allowed for amplification of either 5' or 3' ends, depending on the orientation of the gene specific primer (GSP) that was chosen. An aliquot of the double stranded cDNA was added to the following reagents: 10 µM Marathon cDNA adapter, 5×DNA ligation buffer, T4 DNA ligase. The reaction was incubated at 16° C. overnight. The reaction was heat inactivated to terminate the reaction. PCR was performed by the addition of the following to the diluted double stranded cDNA pool: 10×cDNA PCR reaction buffer, 10 µM dNTP mix, 10 µM GSP, 10 µM AP1 primer (kit), 50×Advantage cDNA Polymerase Mix. Thermal Cycling conditions were 94° C. for 30 seconds, 5 cycles of 94° C. for 5 seconds, 72° C. for 4 minutes, 5 cycles of 94° C. for 5 seconds, 70° C. for 4 minutes, 23 cycles of 94° C. for 5 seconds, 68° C. for 4 minutes. After the first round of PCR was performed using the GSP to extend to the end of the adapter to create the adapter primer binding site, exponential amplification of the specific cDNA of interest was observed. Usually a second nested PCR is preformed to confirm the specific cDNA. The RACE product was analyzed on an agarose gel and then excised and purified from the gel (GeneClean, BIO 101). The RACE product was then cloned into pCTNR (General Contractor DNA Cloning System, 5'-3', Inc.) and the DNA sequence determined to verify that the clone is specific to the gene of interest.

13. Mutation Analysis

Comparative genes were identified using the above procedures and the exons from each gene were subjected to mutation detection analysis. Comparative DNA sequencing was used to identify polymorphisms in HBM candidate genes from chromosome 11q12-13. DNA sequences for candidate genes were amplified from patient lymphoblastoid cell lines.

The inventors developed a method based on analysis of direct DNA sequencing of PCR products amplified from candidate regions to search for the causative polymorphism. The procedure consisted of three stages that used different subsets of HBM family to find segregating polymorphisms and a population panel to assess the frequency of the polymorphisms. The family resources result from a single founder leading to the assumption that all affected individuals will share the same causative polymorphism.

Candidate regions were first screened in a subset of the HBM family consisting of the proband, daughter, and her mother, father and brother. Monochromosomal reference sequences were produced concurrently and used for comparison. The mother and daughter carried the HBM polymorphism in this nuclear family, providing the ability to monitor polymorphism transmission. The net result is that two HBM chromosomes and six non-HBM chromosomes were screened. This allowed exclusion of numerous frequent alleles. Only alleles exclusively present in the affected individuals passed to the next level of analysis.

Polymorphisms that segregated exclusively with the HBM phenotype in this original family were then re-examined in an extended portion of the HBM pedigree consisting of two additional nuclear families. These families consisted of five HBM and three unaffected individuals. The HBM individuals in this group included the two critical crossover individuals, providing the centromeric and telomeric boundaries of the critical region. Tracking the heredity of polymorphisms between these individuals and their affected parents allowed for further refining of the critical region. This group brought the total of HBM chromosomes screened to seven and the total of non-HBM chromosomes to seventeen.

When a given polymorphism continued to segregate exclusively with the HBM phenotype in the extended group, a population panel was then examined. This panel of 84 persons consisted of 42 individuals known to have normal bone mineral density and 42 individuals known to be unrelated but with untyped bone mineral density. For this purpose, normal bone mineral density is within two standard deviations of a BMD Z score of 0. The second group was from the widely used CEPH panel of individuals. Any segregating polymorphisms found to be rare in this population were subsequently examined on the entire HBM pedigree and a larger population.

Polymerase chain reaction (PCR) was used to generate sequencing templates from the HBM family's DNA and monochromosomal controls. Enzymatic amplification of genes within the HBM region on 11q12-13 was accomplished using the PCR with oligonucleotides flanking each exon as well as the putative 5' regulatory elements of each gene. The primers were chosen to amplify each exon as well as 15 or more base pairs within each intron on either side of the splice. All PCR primers were made as chimeras to facilitate dye primer sequencing. The M13-21F (5'-GTA A CGA CGG CCA GT-3') (SEQ ID NO:30) and —28REV (5'-AAC AGC TAT GAC CAT G -3') (SEQ ID NO:31) primer binding sites were built on to the 5' end of each forward and reverse PCR primer, respectively, during synthesis. 150 ng of genomic DNA was used in a 50 µl PCR with 2 U AmpliTaq, 500 nM primer and 125 µM dNTP. Buffer and cycling conditions were specific to each primer set. TaqStart antibody (Clontech) was used for hot start PCR to minimize primer dimer formation. 10% of the product was examined on an agarose gel. The appropriate samples were diluted 1:25 with deionized water before sequencing.

Each PCR product was sequenced according to the standard Energy Transfer primer (Amersham) protocol. All reactions took place in 96 well trays. 4 separate reactions, one each for A, C, G and T were performed for each template. Each reaction included 2 µl of the sequencing reaction mix and 3 µl of diluted template. The plates were then heat sealed with foil tape and placed in a thermal cycled and cycled according to the manufacturer's recommendation. After cycling, the 4 reactions were pooled. 3 µl of the pooled product was transferred to a new 96 well plate and 1 µl of the manufacturer's loading dye was added to each well. All 96 well pipetting procedures occurred on a Hydra 96 pipetting station (Robbins Scientific, USA). 1 µl of pooled material was directly loaded onto a 48 lane gel running on an ABI 377 DNA sequencer for a 10 hour, 2.4 kV run.

Polyphred (University of Washington) was used to assemble sequence sets for viewing with Consed (University of Washington). Sequences were assembled in groups representing all relevant family members and controls for a specified target region. This was done separately for each of the three stages. Forward and reverse reads were included for each individual along with reads from the monochromosomal templates and a color annotated reference sequence. Polyphred indicated potential polymorphic sites with a purple flag. Two readers independently viewed each assembly and assessed the validity of the purple-flagged sites.

A total of 23 exons present in the mature mRNA and several other portions of the primary transcript were evaluated for heterozygosity in the nuclear family of two HBM-affected and two unaffected individuals. 25 SNPs were identified, as shown in the table below.

TABLE 8

Single Nucleotide Polymorphisms in the Zmax1 (LRP5) Gene and Environs

| Exon Name | Location | Base Change |
|---|---|---|
| b200e21-h_Contig1_1.nt | 69169 (309G) | C/A |
| b200e21-h_Contig4_12.nt | 27402 (309G) | A/G |
| b200e21-h_Contig4_13.nt | 27841 (309G) | T/C |
| b200e21-h_Contig4_16.nt | 35600 (309G) | A/G |
| b200e21-h_Contig4_21.nt | 45619 (309G) | G/A |
| b200e21-h_Contig4_22.nt-a | 46018 (309G) | T/G |
| b200e21-h_Contig4_22.nt-b | 46093 (309G) | T/G |
| b200e21-h_Contig4_22.nt-c | 46190 (309G) | A/G |
| b200e21-h_Contig4_24.nt-a | 50993 (309G) | T/C |
| b200e21-h_Contig4_24.nt-b | 51124 (309G) | C/T |
| b200e21-h_Contig4_25.nt | 55461 (309G) | C/T |
| b200e21-h_Contig4_33.nt-a | 63645 (309G) | C/A |
| b200e21-h_Contig4_33.nt-b | 63646 (309G) | A/C |
| b200e21-h_Contig4_61.nt | 24809 (309G) | T/G |
| b200e21-h_Contig4_62.nt | 27837 (309G) | T/C |
| b200e21-h_Contig4_63.nt-a | 31485 (309G) | C/T |
| b200e21-h_Contig4_63.nt-b | 31683 (309G) | A/G |
| b200e21-h_Contig4_9.nt | 24808 (309G) | T/G |
| b527d12-h_Contig030g_1.nt-a | 31340 (308G) | T/C |
| b527d12-h_Contig030g_1.nt-b | 32538 (308G) | A/G |
| b527d12-h_Contig080C_2.nt | 13224 (308G) | A/G |
| b527d12-h_Contig087C_1.nt | 21119 (308G) | C/A |
| b527d12-h_Contig087C_4.nt | 30497 (308G) | G/A |
| b527d12-h_Contig088C_4.nt | 24811 (309G) | A/C |
| b527d12-h_Contig089_1HP.nt | 68280 (309G) | G/A |

In addition to the polymorphisms presented in Table 8, two additional polymorphisms can also be present in SEQ ID NO:2. These is a change at position 2002 of SEQ ID NO:2. Either a guanine or an adenine can appear at this position. This polymorphism is silent and is not associated with any change in the amino acid sequence. The second change is at position 4059 of SEQ ID NO:2 corresponding in a cytosine (C) to thymine (T) change. This polymorphism results in a corresponding amino acid change from a valine (V) to an alanine (A). Other polymorphisms were found in the candidate gene exons and adjacent intron sequences as displayed in Tables 2 and 3. Any one or combination of the polymorphisms listed in Tables 2, 3 or 8 or the two discussed above could also have a minor effect on bone mass when present in SEQ ID NO:2. These could also be in combination with any of the other mutations discussed in Section 3 and in the Examples below.

The present invention encompasses the nucleic acid sequences having the nucleic acid sequence of SEQ ID NO: 1 with any one or more of the above-identified point mutations.

Preferably, the present invention encompasses the nucleic acid of SEQ ID NO: 2 or is a mutation in SEQ ID NO: 1 that produces a phenotype like that observed with the protein encoded by SEQ ID NO:2 (HBM phenotype). Specifically, a base-pair substitution changing G to T at position 582 in the coding sequence of Zmax1 (the HBM gene) was identified as heterozygous in all HBM individuals, and not found in the unaffected individuals (i.e., b527d12-h_Contig087C_1.nt).

FIG. 6 shows the order of the contigs in B527D12. The direction of transcription for the HBM gene is from left to right. The sequence of contig308G of B527D12 is the reverse complement of the coding region to the HBM gene. Therefore, the relative polymorphism in contig 308G shown in Table 8 as a base change substitution of C to A is the complement to the G to T substitution in the HBM gene. This mutation causes a substitution of glycine 171 with valine (G171V).

The HBM polymorphism was confirmed by examining the DNA sequence of different groups of individuals. In all members of the HBM pedigree (38 individuals), the HBM polymorphism was observed in the heterozygous form in affected (i.e., elevated bone mass) individuals only (N=18). In unaffected relatives (N=20) (BMDZ<2.0), the HBM polymorphism was never observed. To determine whether this polymorphism was ever observed in individuals outside of the HBM pedigree, 297 phenotyped individuals were characterized at the site of the HBM gene. None were heterozygous at the site of the HBM polymorphism. In an unphenotyped control group, none of 64 individuals were observed to be heterozygous at position 582. Taken together, these data prove that the polymorphism observed in the kindred displaying the high bone mass phenotype is strongly correlated with the G-T polymorphism at position 582 of Zmax1 (LRP5). Furthermore, these results coupled with the ASO results described below, establish that the HBM polymorphism genetically segregates with the HBM phenotype, and that both the HBM polymorphism and phenotype are rare in the general population.

13. Allele Specific Oligonucleotide (ASO) Analysis

The amplicon containing the HBM polymorphism was PCR amplified using primers specific for the exon of interest. The appropriate population of individuals was PCR amplified in 96 well microtiter plates as follows. PCR reactions (20 µl) containing 1×Promega PCR buffer (Cat. # M1883 containing 1.5 mM $MgCl_2$), 100 mM DNTP, 200 nM PCR primers (1863F: 5'-CCAAGTTCTGAGAAGTCC-3' and 1864R: 5'-AATACCTGAAACCATACCTG-3'; SEQ ID NOS: 629 and 630 respectively), 1 U AmpliTaq™, and 20 ng of genomic DNA were prepared and amplified under the following PCR conditions: 94° C., 1 minute, (94° C., 30 sec.; 58° C., 30 sec.; 72° C., 1 min X35 cycles), 72° C., 5 min, 4° C., hold. Loading dye was then added and 10 µl of the products was electrophoresed on 1.5% agarose gels containing 1 µg/ml ethidium bromide at 100-150 V for 5-10 minutes. Gels were treated 20 minutes in denaturing solution (1.5 M NaCl, 0.5 N NaOH), and rinsed briefly with water. Gels were then neutralized in 1 M Tris-HCl, pH 7.5, 1.5 M NaCl, for 20 minutes and rinsed with water. Gels were soaked in 10×SSC for 20 minutes and blotted onto nylon transfer membrane (Hybond N+-Amersham) in 10×SSC overnight. Filters were the rinsed in 6×SSC for 10 minutes and UV crosslinked.

The allele specific oligonucleotides (ASO) were designed with the polymorphism approximately in the middle. Oligonucleotides were phosphate free at the 5' end and were purchased from Gibco BRL. Sequences of the oligonucleotides are:

```
2326 Zmax1.ASO.g:
5'-AGACTGGGGTGAGACGC-3'      (SEQ ID NO:631)

2327 Zmax1.ASO.t:
5'-CAGACTGGGTTGAGACGCC-3'    (SEQ ID NO:632)
```

The polymorphic nucleotides are underlined. To label the oligos, 1.5 µl of 1 µg/µl ASO oligo (2326. Zmax1.ASO.g or 2327. Zmax1.ASO.t), 11 µl $ddH_2O$, 2 µl 10×kinase forward buffer, 5 µl $\gamma^{32}P$-ATP (6000 Ci/mMole), and 1 µl T4 polynucleotide kinase (10 U/µl) were mixed, and the reaction incubated at 37° C. for 30-60 minutes. Reactions were then placed at 95° C. for 2 minutes and 30 ml $H_2O$ was added. The probes were purified using a G25 microspin column (Pharmacia).

Blots were prehybridized in 10 ml 5×SSPE, 5×Denhardt's, 2% SDS, and 100 µl/ml, denatured, sonicated salmon sperm DNA at 40° C. for 2 hr. The entire reaction mix of kinased oligo was then added to 10 ml fresh hybridization buffer (5×SSPE, 5×Denhardt's, 2% SDS) and hybridized at 40° C. for at least 4 hours to overnight.

All washes done in 5×SSPE, 0.1% SDS. The first wash was at 45° C. for 15 minutes; the solution was then changed and the filters washed 50° C. for 15 minutes. Filters were then exposed to Kodak biomax film with 2 intensifying screens at −70° C. for 15 minutes to 1 hr. If necessary the filters were washed at 55° C. for 15 minutes and exposed to film again. Filters were stripped by washing in boiling 0.1×SSC, 0.1% SDS for 10 minutes at least 3 times.

Figure 9:
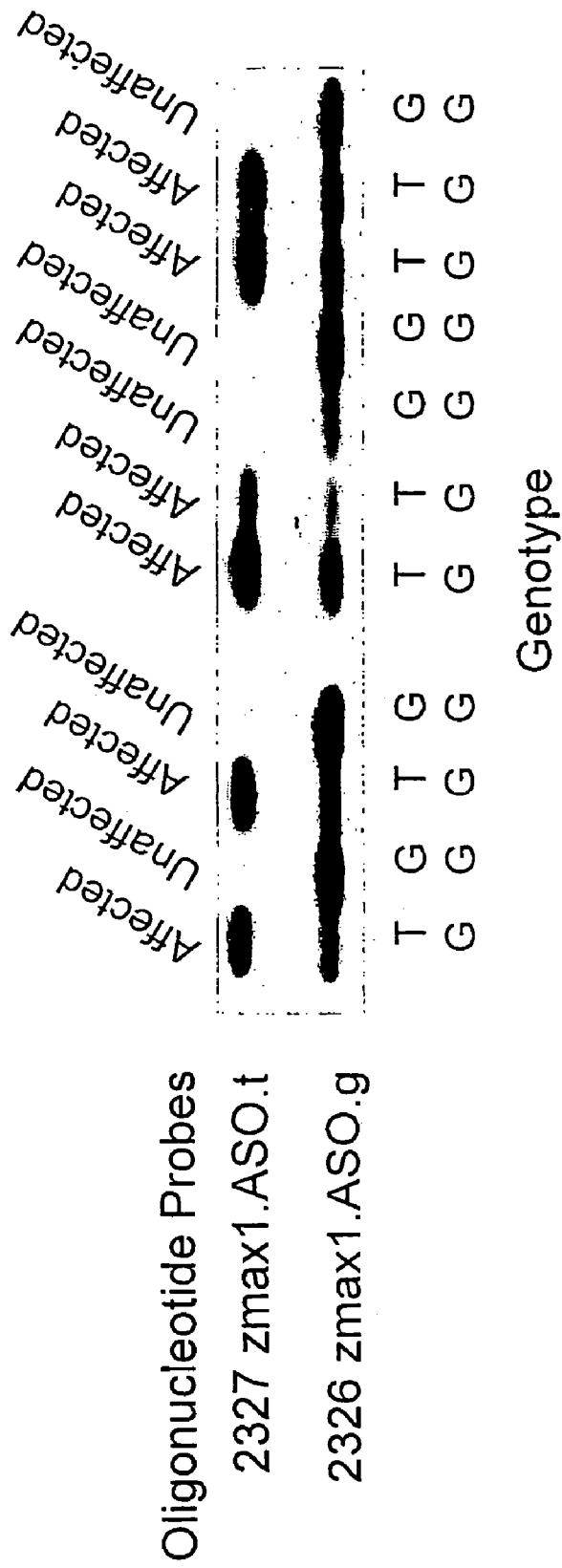
FIG. 9 is allele specific oligonucleotide detection of the Zmax1 (LRP5) exon 3 mutation.

The two films that best captured the allele specific assay with the 2 ASOs were converted into digital images by scanning them into Adobe PhotoShop. These images were overlaid against each other in Graphic Converter and then scored and stored in FileMaker Pro 4.0 (see FIG. 9).

Figure 14:
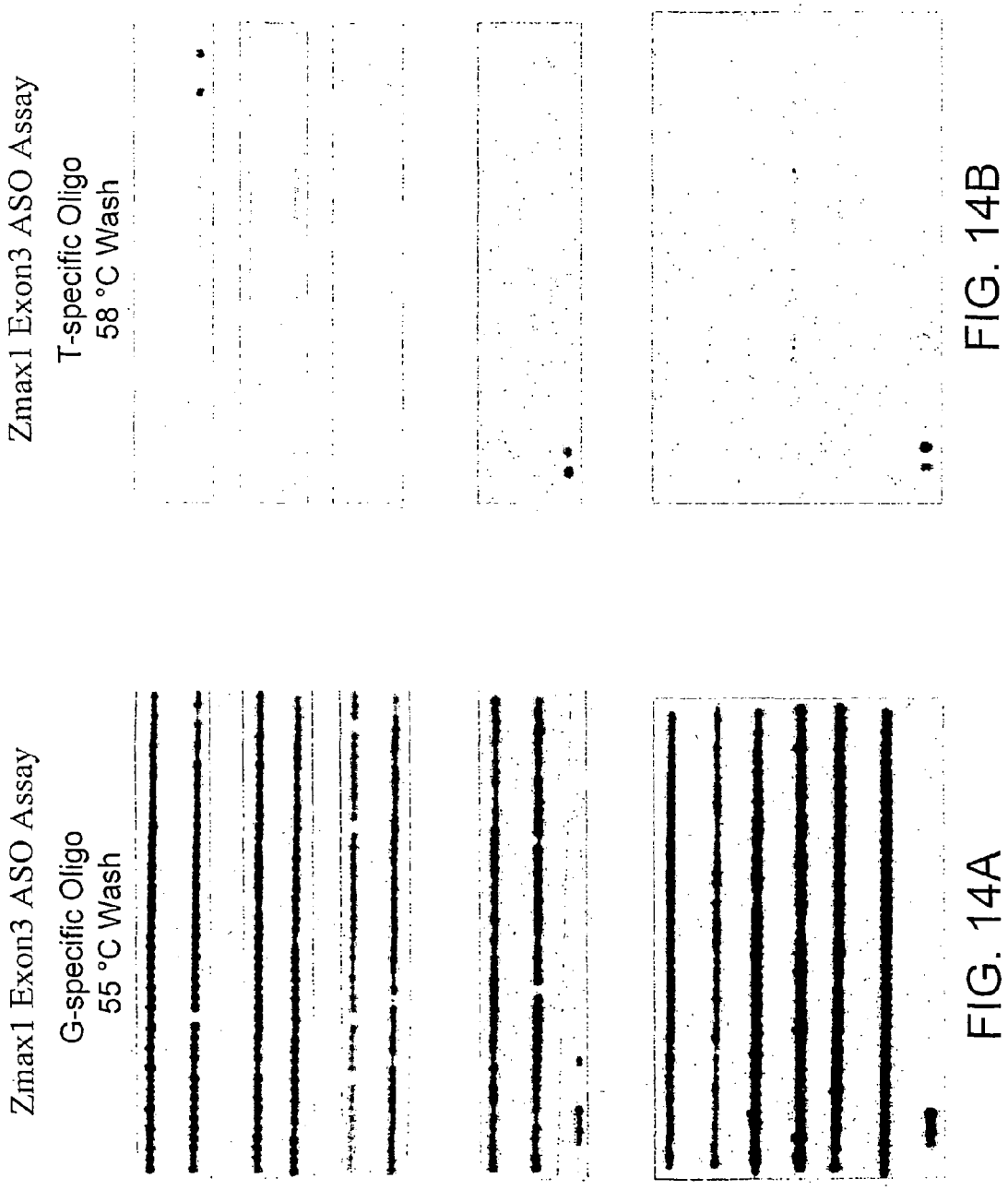
FIG. 14 shows a Zmax1 (LRP5) exon 3 allele specific oligonucleotide (ASO) assay which illustrates the rarity of the HBM allele (right panels; T-specific oligo; 58° C. Wash) as compared to the wild-type Zmax1 (LRP5) allele (left panels, G-specific oligo; 55° C. Wash). The positive spots appearing in the right panels were positive controls.

In order to determine the HBM allele frequency in ethnically diverse populations, 672 random individuals from various ethnic groups were typed by the allele specific oligonucleotide (ASO) method. This population included 96 CEPH grandparents (primarily Caucasian), 192 Caucasian, 192 African-American, 96 Hispanic, and 96 Asian individuals. No evidence was obtained for the presence of the HBM polymorphism in any of these individuals. Overall, a total of 911 individuals were typed either by direct sequencing or ASO hybridization; all were homozygous GG at the, site of the HBM polymorphism (FIG. 14). This information illustrates that the HBM allele is rare in various ethnic populations.

Thus this invention provides a rapid method of identifying individuals with the HBM allele. This method could be used in the area of diagnostics and screening of an individual for susceptibility to osteoporosis or other bone disorder. The assay could also be used to identify additional individuals with the HBM allele or the additional polymorphisms described herein.

14. Cellular Localization of Zmax1 (LRP5)

14.1 Gene Expression in Rat Tibia by Non Isotopic in situ Hybridization

In situ hybridization was conducted by Pathology Associates International (PAI), Frederick, Md. This study was undertaken to determine the specific cell types that express the Zmax1 (LRP5) gene in rat bone with particular emphasis on areas of bone growth and remodeling. Zmax1 (LRP5) probes used in this study were generated from both human (HuZmax1) and mouse (MsZmax1) cDNAs, which share an 87% sequence identity. The homology of human and mouse Zmax1 (LRP5) with rat Zmax1 (LRP5) is unknown.

For example, gene expression by non-isotopic ill situ hybridization was performed as follows, but other methods would be known to the skilled artisan. Tibias were collected from two 6 to 8 week old female Sprague Dawley rats euthanized by carbon dioxide asphyxiation. Distal ends were removed and proximal tibias were snap frozen in OCT embedding medium with liquid nitrogen immediately following death. Tissues were stored in a −80° C. freezer.

Probes for amplifying PCR products from cDNA were prepared as follows. The primers to amplify PCR products from a cDNA clone were chosen using published sequences of both human LRP5 (GenBank Accession No. ABO17498) and mouse LRP5 (GenBanlc Accession No. AF064984). In order to minimize cross reactivity with other genes in the LDL receptor family, the PCR products were derived from an intracellular portion of the protein coding region. PCR was performed in a 50 µl reaction volume using cDNA clone as template. PCR reactions contained 1.5 mM $MgCl_2$, 1 unit AmpliTaq, 200 µM dNTPs and 2 µM each primer. PCR cycling conditions were 94° C. for 1 min., followed by 35 cycles of 94° C. for 30 seconds, 55° C. for 30 seconds, 729C for 30 seconds; followed by a 5 minute extension at 72° C. The reactions were then run on a 1.5% agarose Tris-Acetate gel. DNA was eluted from the agarose, ethanol precipitated and resuspended in 10 mM Tris, pH 8.0. Gel purified PCR products were prepared for both mouse and human cDNAs and supplied to Pathology Associates International for in situ hybridizations.

The sequence of the human and mouse PCR primers and products were as follows:

```
Human Zmax1
(LRP5) sense primer (HBM253)
5'-CCCGTGTGCTCCGCCGCCCAGTTC-3'      (SEQ ID NO:633)

Human Zmax1
(LRP5) antisense primer (HBM465)
5'-GGCTCACGGAGCTCATCATGGACTT-3'     (SEQ ID NO:634)

Human Zmax1 PCR product
5'-CCCGTGTGCTCCGCCGCCCAGTTCCCCTGCG  (SEQ ID NO:635)

CGCGGGGTCAGTGTGTGGACCTGCGCCTGCGCTG

CGACGGCGAGGCAGACTGTCAGGACCGCTCAGAC

GAGGTGGACTGTGACGCCATCTGCCTGCCCAACC

AGTTCCGGTGTGCGAGCGGCCAGTGTGTCCTCAT

CAAACAGCAGTGCGACTCCTTCCCCGACTGTATC

GACGGCTCCGACGAGCTCATGTGTGAAATCACCA

AGCCGCCCTCAGACGACAGCCCGGCCCACAGCAG

TGCCATCGGGCCCGTCATTGGCATCATCCTCTCT

CTCTTCGTCATGGGTGGTGTCTATTTTGTGTGCC

AGCGCGTGGTGTGCCAGCGCTATGCGGGGCCAA

CGGGCCCTTCCCGCACGAGTATGTCAGCGGGACC

CCGCACGTGCCCCTCAATTTCATAGCCCCGGGCG

GTTCCCAGCATGGCCCCTTCACAGGCATCGCATG

CGGAAAGTCCATGATGAGCTCCGTGAGCC-3'

Mouse Zmax1 (LRP5)
Sense primer (HBM655)
5'-AGCGAGGCCACCATCCACAGG-3'         (SEQ ID NO:636)

Mouse Zmax1 (LRP5)
antisense primer (HBM656)
5'-TCGCTGGTCGGCATAATCAAT-3'         (SEQ ID NO:637)

Mouse (LRP5) 1 PCR product
5'-AGCAGAGCCACCATCCACAGGATCTCCCTGG  (SEQ ID NO:638)

AGACTAACAACAACGATGTGGCTATCCCACTCAC

-continued
GGGTGTCAAAGAGGCCTCTGCACTGGACTTTGAT

GTGTCCAACAATCACATCTACTGGACTGATGTTA

GCCTCAAGACGATCAGCCGAGCCTTCATGAATGG

GAGCTCAGTGGAGCACGTGATTGAGTTTGGCCTC

GACTACCCTGAAGGAATGGCTGTGGACTGGATGG

GCAAGAACCTCTATTGGGCGGACACAGGGACCAA

CAGGATTGAGGTGGCCCGGCTGGATGGGCAGTTC

CGGCAGGTGCTTGTGTGGAGAGACCTTGACAACC

CCAGGTCTCTGGCTCTGGATCCTACTAAAGGCTA

CATCTACTGGACTGAGTGGGGTGGCAAGCCAAGG

ATTGTGCGGGCCTTCATGGATGGGACCAATTGTA

TGACACTGGTAGACAAGGTGGGCCGGGCCAACGA

CCTCACCATTGATTATGCCGACCAGCGA-3'
```

Riboprobes were synthesized as follows. The PCR products were reamplified with chimeric primers designed to incorporate either a T3 promoter upstream, or a T7 promoter downstream of the reamplification products. The resulting PCR products were used as template to synthesize digoxigenin-labeled riboprobes by in vitro transcription (TVT). Antisense and sense riboprobes were synthesized using T7 and T3 RNA polymerases, respectively, in the presence of digoxigenin-11-UTP (Boehringer-Mannheim) using a MAXIscript IVT kit (Ambion) according to the manufacturer. The DNA was then degraded with Dnase-1, and unincorporated digoxigenin was removed by ultrafiltration. Riboprobe integrity was assessed by electrophoresis through a denaturing polyacrylamide gel. Molecular size was compared with the electrophoretic mobility of a 100-1000 base pair (bp) RNA ladder (Ambion). Probe yield and labeling was evaluated by blot immunochemistry. Riboprobes were stored in 5 µl aliquots at −80° C.

The in situ hybridization was performed as follows. Frozen rat bone was cut into 5 µM sections on a Jung CM3000 cryostat (Leica) and mounted on adhesive slides (Instrumedics). Sections were kept in the cryostat at −20° C. until all the slides were prepared in order to prevent MRNA degradation prior to post-fixation for 15 minutes in 4% paraformaldehyde. Following post-fixation, sections were incubated with 1 ng/µl of either antisense or sense riboprobe in Pathology Associates International (PAI) customized hybridization buffer for approximately 40 hours at 58° C. Following hybridization, slides were subjected to a series of post-hybridization stringency washes to reduce nonspecific probe binding. Hybridization was visualized by immunohistochemistry with an anti-digoxigenin antibody (FAB fragment) conjugated to alkaline phosphatase. Nitroblue tetrazolium chloride/bromo-chloroindolyl phosphate (Boehringer-Mannheim), a precipitating alkaline phosphatase substrate, was used as the chromogen to stain hybridizing cells purple to nearly black, depending on the degree of staining. Tissue sections were counter-stained with nuclear fast red. Assay controls included omission of the probe, omission of probe and anti-digoxigenin antibody.

Specific cell types were assessed for demonstration of hybridization with antisense probes by visualizing a purple to black cytoplasmic and/or peri-nuclear staining indicating a positive hybridization signal for mRNA. Each cell type was compared to the replicate sections, which were hybridized with the respective sense probe. Results were considered positive if staining was observed with the antisense probe and no staining or weak background with the sense probe.

Figure 10A:
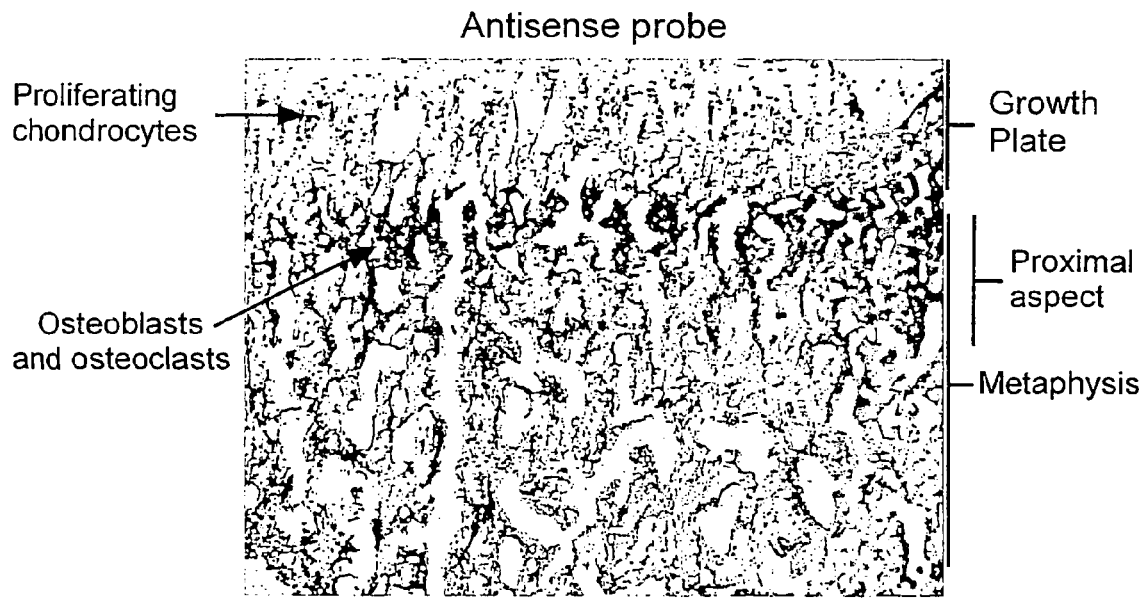
FIG. 10 is the cellular localization of mouse Zmax1 (LRP5) by in situ hybridization at 100× magnification using sense and antisense probes.
Figure 10B:
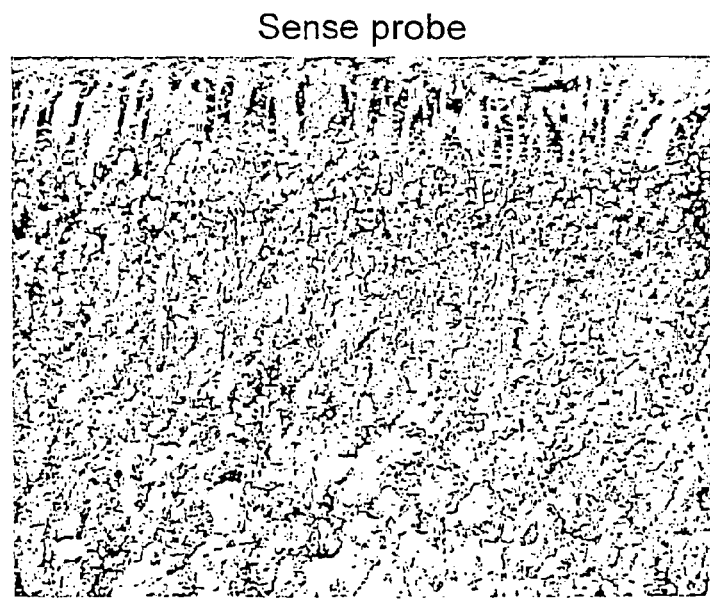
Figure 11A:
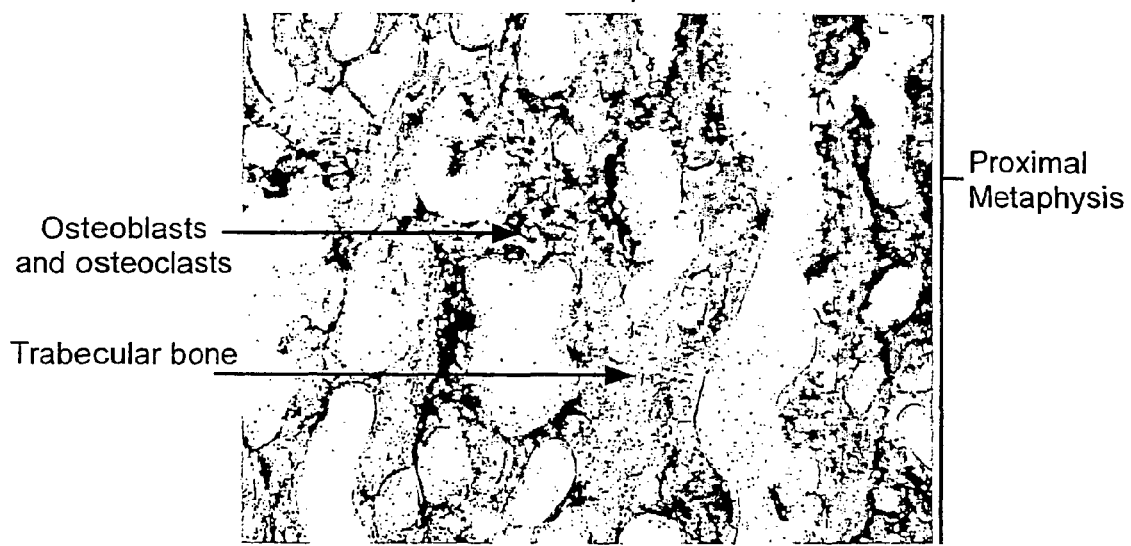
FIG. 11 is the cellular localization of mouse Zmax1 (LRP5) by in situ hybridization at 400× magnification using sense and antisense probes.
Figure 11B:
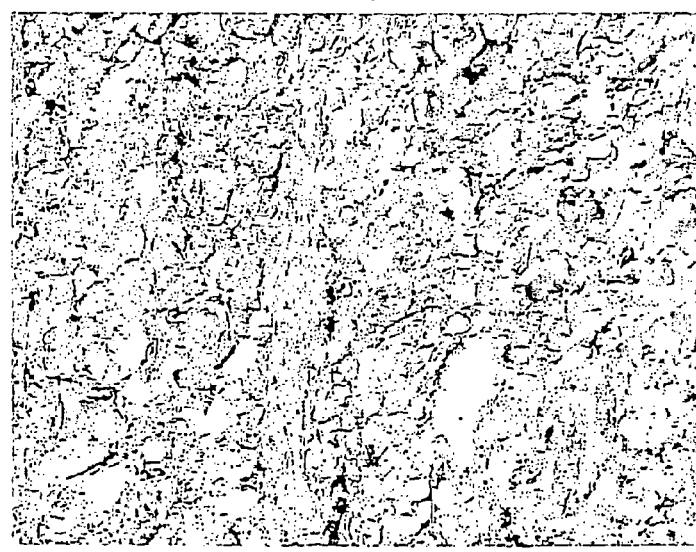
Figure 12A:
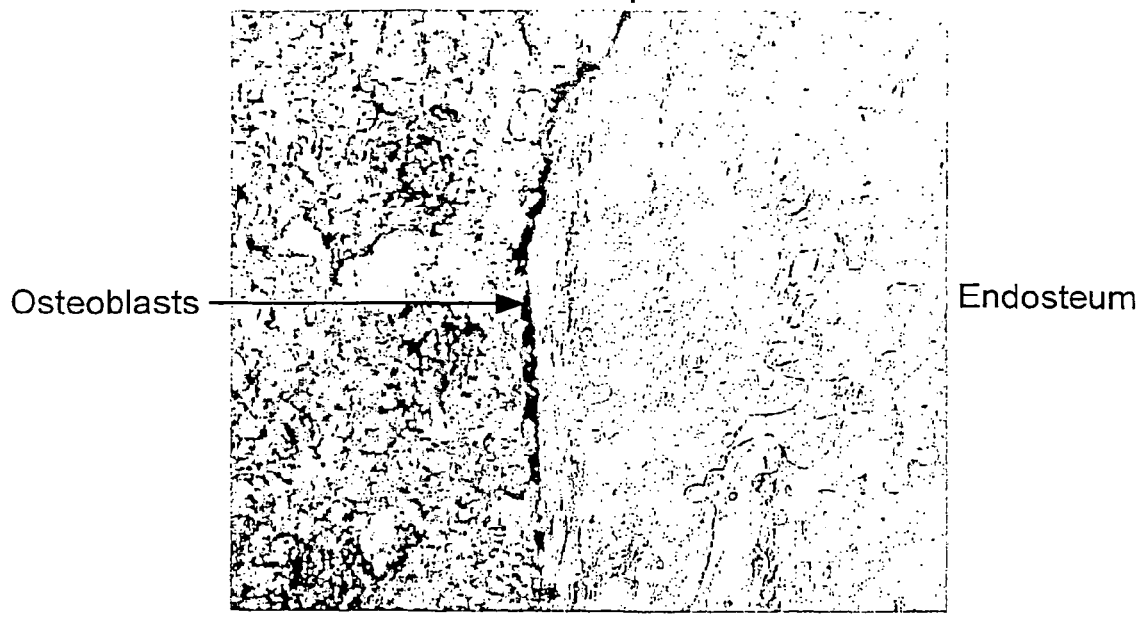
FIG. 12 is the cellular localization of mouse Zmax1 (LRP5) by in situ hybridization of osteoblasts in the endosteum at 400× magnification using sense and antisense probes.
Figure 12B:

The cellular localization of the hybridization signal for each of the study probes is summarized in Table 9. Hybridization for Zmax1 (LRP5) was primarily detected in areas of bone involved in remodeling, including the endosteum and trabecular bone within the metaphysis. Hybridization in selected bone lining cells of the periosteum and epiphysis were also observed. Positive signal was also noted in chondrocytes within the growth plate, particularly in the proliferating chondrocytes. See FIGS. 10, 11 and 12 for representative photomicrographs of in situ hybridization results.

TABLE 9

Summary of Zmax1 (LRP5) in situ hybridization in rat tibia

| PROBE | SITE | ISH SIGNAL |
|---|---|---|
| Hu Zmax1 | Epiphysis | |
| | Osteoblasts | + |
| | Osteoclasts | − |
| | Growth Plate | |
| | resting chondrocytes | − |
| | proliferating chondrocytes | + |
| | hypertrophic chondrocytes | − |
| | Metaphysis | |
| | osteoblasts | + |
| | osteoclasts | + |
| | Diaphysis | − |
| | Endosteum | |
| | osteoblasts | + |
| | osteoclasts | + |
| | Periosteum | − |
| MsZmax1 | Epiphysis | |
| | Osteoblasts | + |
| | Osteoclasts | − |
| | Growth Plate | |
| | resting chondrocytes | − |
| | proliferating chondrocytes | + |
| | hypertrophic chondrocytes | + |
| | Metaphysis | |
| | osteoblasts | + |
| | osteoclasts | + |
| | Diaphysis | − |
| | Endosteum | |
| | osteoblasts | + |
| | osteoclasts | + |
| | Periosteum | + |

Legend:
"+" = hybridization signal detected
"−" = no hybridization signal detected
"ISH"—In situ hybridization These studies confirm the positional expression of Zmax1 (LRP5) in cells involved in bone remodeling and bone formation. Zmax1 (LRP5) expression in the zone of proliferation and in the osteoblasts and osteoclasts of the proximal metaphysis, suggests that the Zmax1 (LRP5) gene is involved in the process of bone growth and mineralization. The activity and differentiation of osteoblasts and osteoclasts are closely coordinated during development as bone is formed and during growth as well as in adult life as bone undergoes continuous remodeling. The formation of internal bone structures and bone remodeling result from the coupling of bone resorption by activated osteoclasts with subsequent deposition of new material by osteoblasts. Zmax1 (LRP5) is related to the LDL receptor gene, and thus may be a receptor involved in mechanosensationl and subsequent signaling in the process of bone remodeling. Therefore, changes in the level of expression of this gene could impact on the rate of remodeling and degree of mineralization of bone.

15. Antisense

Antisense oligonucleotides are short synthetic nucleic acids that contain complementary base sequences to a targeted RNA. Hybridization of the RNA in living cells with the antisense oligonucleotide interferes with RNA function and ultimately blocks protein expression. Therefore, any gene for which the partial sequence is known can be targeted by an antisense oligonucleotide.

Antisense technology is becoming a widely used research tool and will play an increasingly important role in the validation and elucidation of therapeutic targets identified by genomic sequencing efforts.

Antisense technology was developed to inhibit gene expression by utilizing an oligonucleotide complementary to the mRNA that encodes the target gene. There are several possible mechanisms for the inhibitory effects of antisense oligonucleotides. Among them, degradation of mRNA by RNase H is considered to be the major mechanism of inhibition of protein function. This technique was originally used to elucidate the function of a target gene, but may also have therapeutic applications, provided it is designed carefully and properly.

An antisense oligonucleotide can be, for example, about 5, 10, 15, 20, 25, 30, 35, 40, 45 or 50 nucleotides in length. An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl)uracil, 5-carboxyrn-ethylaminomethyl-2-thiouridine, 5-carboxymethlaniinom-ethyluracil, dihydrouracil, P-D-galactosylqueosine, inosine, N6-isopentenyladenine, I-methylguanine, I-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminom-ethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), t-methyl-2-thiouracil, 3-(3-amino-3-N-2-carboxypropyl)uracil, (acp3)w, and 2,6-diaminopurine.

In addition, the use of morpholino oligonucleotides could be employed. Morpholinos are oligomers with modification of the ribose moiety to a morpholino group. This technology is covered by U.S. Pat. No. 5,185,444 and is described in Summerton et al., 1997 *Antisense Nucleic Acid Ding Dev.* 7(3): 187-95. The antisense nucleic acid molecules of the invention are typically administered to a subject or generated in situ such that they hybridize with or bind to cellular mRNA and/or genomic DNA encoding an HBM or Zmax1 (LRP5) protein or a protein which interacts with Zmax1 (LRP5) and/or HBM to thereby inhibit expression of the protein, e.g., by inhibiting transcription and/or translation. The hybridization can be by conventional nucleotide complementary to form a stable duplex, or, for example, in the case of an antisense nucleic acid molecule which binds to DNA duplexes, through specific interactions in the major groove of the double helix. An example of a route of administration of an antisense nucleic acid molecule of the invention includes direct injection at a tissue site. Alternatively, an antisense nucleic acid molecule can be modified to target selected cells and then administered systemically. For example, for systemic administration, an antisense molecule can be modified such that it specifically binds to a receptor or an antigen expressed on a selected cell surface, e.g., by linking the antisense nucleic acid molecule to a peptide or an antibody which binds to a cell surface receptor or antigen. The antisense nucleic acid molecule can also be delivered to cells using the vectors described herein.

In yet another embodiment, the antisense nucleic acid molecule of the invention is an α-anomeric nucleic acid molecule. An μ-anomeric nucleic acid molecule forms specific double-stranded hybrids with complementary RNA in which, contrary to the usual γ-units, the strands run parallel to each other (Gaultier et al., 1987 *Nucl. Acids Res.* 15: 6625-41). The antisense nucleic acid molecule can also comprise a 2'-o-methylribonucleotide (Inoue et al., 1987 *Nucl. Acids Res.* 15: 6131-6148) or a chimeric RNA-DNA analogue (Inoue et al., 1987 *FEBS Lett.* 215: 327-330). In still another embodiment, an antisense nucleic acid of the invention is a ribozyme. Ribozymes are catalytic RNA molecules with ribonuclease activity which are capable of cleaving a single-stranded nucleic acid, such as an MRNA, to which they have a complementary region. Thus, ribozymes (e.g., hammerhead ribozymes (described in Haselhoff et al. 1988 *Nature* 334: 585-591) can be used to catalytically cleave Zmax1 (LRP5) or BM mRNA transcripts to thereby inhibit translation of Zmax1 (LRP5) or HBM mRNA. A ribozyme having specificity for a Zmax1- or HBM-encoding nucleic acid can be designed based upon the nucleotide sequence of a Zmax1 (LRP5) or HBM cDNA disclosed herein (i.e., SEQ ID NOS:1 or 3). For example, a derivative of a Tetraliymena L-19 IVS RNA can be constructed in which the nucleotide sequence of the active site is complementary to the nucleotide sequence to be cleaved in an HBM or Zmax1-encoding mRNA. See, e.g., Cech et al. U.S. Pat. No. 4,987,071 and Cech et al. U.S. Pat. No. 5,116,742 both incorporated herein by reference. Alternatively, Zmax1 (LRP5) or HBM mRNA can be used to select a catalytic RNA having a specific ribonuclease activity from a pool of RNA molecules. See, e.g., Bartel et al., 1993 *Science* 261: 1411-1418. Alternatively, Zinax1 (LRP5) or HBM gene expression can be inhibited by targeting nucleotide sequences complementary to the regulatory region of the Zmax1 (LRP5) or HBM gene (e.g., the Zmax1 or HBM gene promoter and/or enhancers) to form triple helical structures that prevent transcription of the Zmax1 (LRP5) or HBM genes in target cells. See generally, Helene, 1991 *Anticancer Drug Des.* 6(6):569-84; Helene et al., 1992 *Ann. N.Y. Acad. Sci.* 660:27-36; and Maher, 1992 *Bioassays* 14(12):807-15.

Zmax1 (LRP5), LRP6, HBM-like and HBM gene expression can also be inhibited using RNA interference (RNAi) caused by small inhibitory RNAs (siRNAs). This is a technique for post-transcriptional gene silencing (PTGS), in which target gene activity is specifically abolished with cognate double-stranded RNA (dsRNA). siRNAs resemble in many aspects PTGS in plants and has been detected in many invertebrates including trypanosome, hydra, planaria, nematode and fruit fly (*Drosophila melanogaster*). It may be involved in the modulation of transposable element mobilization and antiviral state formation. RNAi in mammalian systems is disclosed in PCT application WO 00/63364 which is incorporated by reference herein in its entirety. See also, Elbashir et al., 2001 *Nature* 411: 494-98. Basically, dsRNA, homologous to the target (Zmax1 or HBM) is introduced into the cell and a sequence specific reduction in gene activity is observed.

Another embodiment contemplates the use of small hairpin RNAs (shRNAs). These compounds are described further in Yu et al., 2002 *Proc. Natl. Acad. Sci. USA* 99: 6047-52; and Paddison et al., 2002 *Genes & Devel.* 16: 948-58.

As an example, preparing antisense oligonucleotides can be performed as follows. Studies have been undertaken using antisense technology in the osteoblast-like murine cell line, MC3T3. These cells can be triggered to develop along the bone differentiation sequence. An initial proliferation period is characterized by minimal expression of differentiation markers and initial synthesis of collagenous extracellular matrix. Collagen matrix synthesis is required for subsequent induction of differentiation markers. Once the matrix synthesis begins, osteoblast marker genes are activated in a clear temporal sequence: alkaline phosphatase is induced at early times while bone sialoprotein and osteocalcin appear later in the differentiation process. This temporal sequence of gene expression is useful in monitoring the maturation and mineralization process. Matrix mineralization, which does not begin until several days after maturation has started, involves deposition of mineral on and within collagen fibrils deep within the matrix near the cell layer-culture plate interface. The collagen fibril-associated mineral formed by cultured osteoblasts resembles that found in woven bone in vivo and therefore is used frequently as a study reagent.

MC3T3 cells were transfected with antisense oligonucleotides for the first week of the differentiation, according to the manufacturer's specifications (U.S. Pat. No. 5,849,902).

The oligonucleotides designed for Zmax1 (LRP5) are given below:

```
10875:
5'-AGUACAGCUUCUUGCCAACCCAGUC-3'   (SEQ ID NO:639)

10876:
5'-UCCUCCAGGUCGAUGGUCAGCCCAU-3'   (SEQ ID NO:640)

10877:
5'-GUCUGAGUCCGAGUUCAAAUCCAGG-3'   (SEQ ID NO:641)
```

Figure 13:
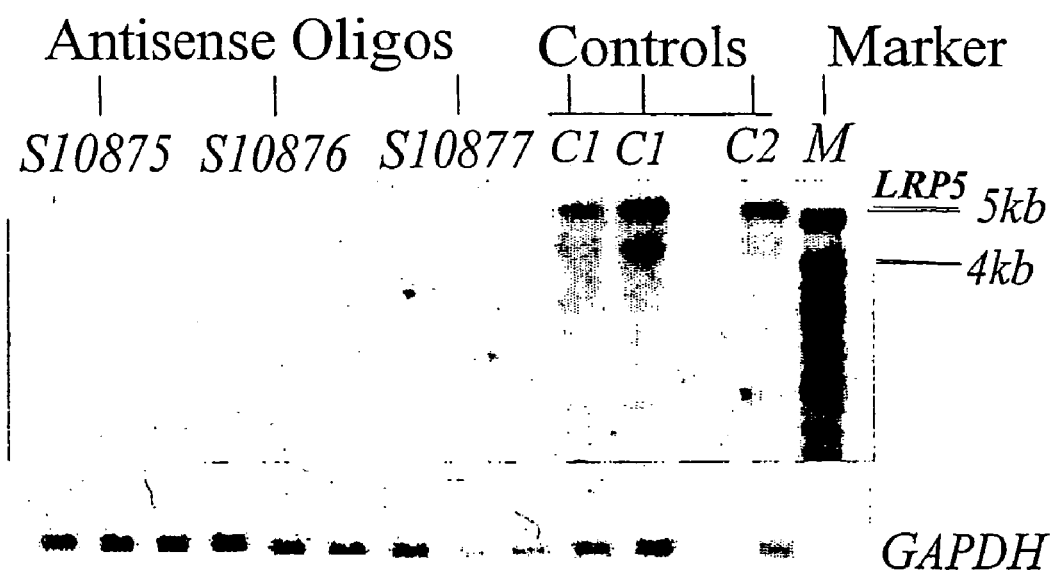
FIG. 13 shows antisense inhibition of Zmax1 (LRP5) expression in MC-3T3 cells.

FIG. 13 shows the results of antisense inhibition of (LRP5) 1 in MC3T3 cells. The three oligonucleotides shown above were transfected into MC3T3 and RNA was isolated according to standard procedures. Northern analysis clearly shows markedly lower steady state levels of the Zmax1 (LRP5) transcript while the control gene GAPDH remained unchanged. Thus, antisense technology using the primers described above allows for the study of the role of Zmax1 (LRP5) expression on bone biology.

16. Yeast Two Hybrid

In order to identify the signaling pathway that Zmax1 (LRP5) participates in to modulate bone density, the yeast two hybrid protein interaction technology was utilized. This technique facilitates the identification of proteins that interact with one another by coupling tester proteins to components of a yeast transcription system (Fields et al., 1989 *Nature* 340: 245-246; U.S. Pat. No. 5,283,173 by Fields et al.; Johnston, 1987 *Microbiol. Rev.* 51: 458-476; Keegan et al., 1986 *Science* 231: 699-704; Durfee et al., 1993, *Genes Dev.* 7: 555-569; Chien et al., 1991 *Proc. Natl. Acad. Sci USA* 88: 9578-9582; Fields et al., 1994 *Triends in Genetics* 10: 286-292; and Gyuris et al., 1993 *Cell* 75: 791-803). First a "bait" protein, the protein for which one seeks interacting proteins, is fused to the DNA binding domain of a yeast transcription factor.

Second, a cDNA library is constructed that contains cDNAs fused to the transcriptional activation domain of the same yeast transcription factor; this is termed the prey library. The bait construct and prey library are transformed into yeast cells and then mated to produce diploid cells. If the bait interacts with a specific prey from the cDNA library, the activation domain is brought into the vicinity of the promoter via this interaction. Transcription is then driven through selectable marker genes and growth on selective media indicates the presence of interacting proteins.

The amino acid sequence used in the yeast two hybrid experiments discussed herein consisted of the entire cytoplasmic domain and a portion of the transmembrane domain and is shown below (amino to carboxy orientation):

(SEQ ID NO:765)
RVVCQRYAGA NGPFPHEYVS GTPHVPLNFI APGGSQHGPF

TGIACGKSMM SSVSLMGGRG GVPLYDRNHV TGASSSSSSS

TKATLYPPIL NPPPSPATDP SLYNMDMFYS SNIPATVRPY

RPYIIRGMAP PTTPCSTDVC DSDYSASRWK ASKYYLDLNS

DSDPYPPPPT PHSQYLSAED SCPPSPATER SYFHLFPPPP

SPCTDSS

The last 6 amino acids of the putative transmembrane domain are indicated in bold. Putative SH3 domains are underlined. Additional amino acid sequences of 50 amino acids or greater in either the proteins encoded by the Zmax1 (LRP5) or HBM alleles can also be used as bait. The upper size of the polypeptide used as bait is limited only by the presence of a complete transmembrane domain (see FIG. 4), which will render the bait to be nonfunctional in a yeast two hybrid system. These additional bait proteins can be used to identify additional proteins which interact with the proteins encoded by HBM or Zmax1 (LRP5) in the focal adhesion signaling pathway or in other pathways in which these HBM or Zmax1 (LRP5) proteins may act. Once identified, methods of identifying agents which regulate the proteins in the focal adhesion signaling pathway or other pathways in which HBM acts can be performed as described herein for the HBM and Zmax1 (LRP5) proteins.

In order to identify cytoplasmic Zmax1 (LRP5) signaling pathways, the cytoplasmic domain of Zmax1 (LRP5) was subcloned into two bait vectors. The first vector was pDBleu, which was used to screen a brain, and Hela prey cDNA library cloned into the vector pPC86 (Clontech). The second bait vector used was pDBtrp, which was used to screen a cDNA prey library derived from the TE85 osteosarcoma cell line in vector pOP46. Another suitable vector which is widely available, is p86 (Gibco, iest™ System). Standard techniques known to those skilled in the art were used as described in Fields and Song, 1989 *Nature* 340: 245-246; U.S. Pat. No. 5,283,173 by Fields and Son; Johnston, 1987 *Microbiol. Rev,.* 51: 458-476; Keegan et al., 1986 *Scienice* 231: 699-704; Durfee et al., 1993 *Genes Dev.* 7: 555-569; Chien et al., 1991 *Proc. Natl. Acad. Sci USA* 88: 9578-9582; Fields et al., 1994 *Trends in Genetics* 10: 286-292; and Gyuris et al., 1993 *Cell* 75i: 791-803. The bait construct and prey cDNA libraries were transformed into yeast using standard procedures.

To perform the protein interaction screen, an overnight culture of the bait yeast strain was grown in 20 ml SD selective medium with 2% glucose (pDBLeu, SD -Leu medium, pDBtrp, SD-trp medium). The cultures were shaken vigorouslyat 30° C. overnight. The cultures were diluted 1:10 with complete medium (YEPD with 2% glucose) and the cultures then incubated with shaking for 2 hrs at 30° C.

The frozen prey library, was thawed, and the yeast cells reactivated by growing them in 150 ml YEPD medium with 2% glucose for 2 hrs at 30° C. A filter unit was sterilized with, 70% ethanol and washed with sterile water to remove the ethanol. The cell densities of both bait and prey cultures were measured by determining the OD at 600 nm. An appropriate volume of yeast cells that corresponded to a cell number of 1 ml of OD 600=4 of each yeast strain, bait and prey (library*) was placed in a 50 ml Falcon tube. The mixture was then filtered through the sterilized filter unit. The filter was then transferred onto a prewarmed YEPD agar plate with the cell side up, removing all air bubbles underneath the filter. Plates were then incubated at 30° C. for 6 hrs. One filter was transferred into a 50 ml Falcon tube, and 10 ml of SD with 2% Glucose was added; cells were resuspended by vortexing for 10 sec.

The number of primary diploid cells (growth on SD-Leu, -Trp plates) versus the numbers of colony forming units growing on SD-Trp and SD-Leu plates only was then titered. Different dilutions were plated and incubated at 30° C. for two days. The number of colony forming units was then counted. The number of diploid colonies (colonies on SD-Leu-Trp plates) permits the calculation of whether or not the whole library of prey constructs was mated to the yeast expressing the bait. This information is important to judge the quality of the screen.

16.1 Indirect Selection

Resuspended cells from 5 filter-matings were then pooled and the cells sedimented by centrifugation in a 50 ml Falcon tube. Cells were then resuspended in 16 ml SD medium with 2% Glc. Two ml of this cell suspension was plated onto 8 square plates each (SD-Leu, -Trp) with sterile glass beads and selected for diploid cells by incubating at 30° C. for 18-20 hrs.

Cells were then scraped off the square plates, the cells centrifuged and combined into one 50 ml Falcon tube. The cell pellet was then resuspended in 25 ml of SD medium with 2% glucose. The cell number was then determined by counting of an appropriate dilution (usually 1:100 to 1:1000) with a Neugebauer chamber. Approximately $5 \times 10^7$ diploid cells were plated onto the selective medium. The observations about the growth of the bait strain together with irrelevant prey vectors helps to determine which selective plates will have to be chosen for the library screen. Generally, all screens were plated on one square plate each with SD-Leu, -Trp, -His; SD -Leu, -Trp, His, 5 mM 3AT, and SD-Leu, -Trp, -His, -Ade is recommended.

The yeast cells were then spread homogeneously with sterile glass beads and incubated at 30° C. for 4 days. The number of colony forming yeast cells was titered by plating different dilutions of the scraped cell suspension onto SD-Leu, -Trp plates. Usually, plating of 100 µl of a $10^{-3}$ and $10^{-4}$ dilution gave 100-1000 colonies per plate.

16.2 Direct Selection

Five filters with the mated yeast cells were each transferred into separate 50 ml Falcon tubes and the cells resuspended with 10 ml SD medium with 2% Glc, each, followed by vortexing for 10 sec. The resuspended cells were combined and centrifuged in a Beckman centrifuge at 3000 rpm. The supernatant was discarded and the cells resuspended in 6 ml of SD medium with 2% Glc. Two ml of the suspension was spread onto each selective square plate and incubated at 30° C. for 4-5 days.

16.3 Isolation of Single Colonies

Yeast cells from an isolated colony were picked with a sterile tooth pick and transferred into individual wells of a 96 well plate. The cells were resuspended in 50 μl of SD -Leu, -Trp, -His medium and incubated at 30° C. for one day. The yeast cells were then stamped onto a SD-Leu, -Trp, -His plate in 96 well format and incubated at 30° C. for 2 days. Yeast cells were also stamped onto a Nylon filter covering a YEPD plate and incubated at 30° C. for one day. The cells on the Nylon filter were used for the analysis of the β-Gal reporter activity.

Yeast colonies were scraped from the SD-Leu, -Trp, -His plate with a sterile tooth pick, and reconfigured, if necessary, according to the β-Gal activity and then resuspended in 20% glycerol. This served as a master plate for storage at −80° C.

For DNA preparation, yeast cells from the glycerol stock were stamped onto a SD-Trp plate and incubated at 30° C. for 2 days. After two days of incubation, the yeast colonies were ready for colony PCR and sequencing. Standard colony PCR conditions were used to amplify inserts from preys recovered from the interaction screen. Sequencing was done using standard sequencing reactions and ABI377 (Perkin Elmer) fluorescent sequencing machines.

16.4 Verification of Bait/Prey Interaction

Glycerol stocks of the prey of interest were thawed and inoculated in a 10 ml overnight culture of SD with glucose -Trp. After overnight growth, plasmid DNA preparation was performed using the BIO 101 RPM Yeast Plasmid Isolation Kit with 10 ml of culture. The culture was centrifuged and transferred to a 1.5 ml microcentrifuge tube. Yeast Lysis Matrix was then added to the pellet followed by 250 μl of Alkaline Lysis Solution. Samples were then vortexed for 5 minutes. 250 μl Neutralizing Solution was added and the sample mixed briefly. Samples were centrifuged for 2 minutes at room temperature in a microcentrifuge. The supernatant was transferred to a Spin Filter avoiding debris and Lysis Matrix. 250 μl of Glassrmilk Spin Buffer was added, and the tubes inverted to mix. Samples were centrifuged for 1 min and the liquid in the Catch Tube was discarded. 500 μl of Wash Solution was added, the samples were centrifuged for 1 min, and the wash solution was discarded. The wash step was repeated once followed by a 1 min dry centrifugation to drive the remaining liquid out of the Spin Filter. The filter was transferred to a new Catch Tube and 100 μl of sterile $H_2O$ was added; samples were then vortexed briefly to resuspend and centrifuged for 30 seconds to collect the DNA in the bottom of the Catch Tube.

Five μl of DNA was then transformed into DH10B Electromax cells using standard procedures and glycerol stocks prepared. Miniprep DNA was prepared using the Qiagen QIAprep Spin Miniprep Kit. DNA was finally eluted with 30 μl of Qiagen EB buffer. One μl of the plasmid DNA samples was then used to transform yeast cells using standard procedures. After 2 days of growth on SD-trp media, colonies were picked and patched onto fresh media. Similarly, bait colonies were patched onto SD-Leu media. Both were grown overnight at 30° C.

For mating, cells from bait and prey patches were spread together on YAPD media and incubated at 30° C. for 12 hr. This plate was then replica plated onto an SD Agar-Leu-Trp plate and grown for 2 days at 30° C. To test the strength of interaction these plates were replica plated onto SD Agar-Leu-Trp-His, SD Agar-Leu-Trp-His with 5 mM 3AT and 10 mM 3AT, SD Agar-Leu-Trp-His-Ade, and SD Agar-Leu-Trp-Ura media and grown for 2 days at 30° C.

16.5 Galacton Star D-Galactosidase Activity Assay

After streaking and replica plating positive interactors on selection plates, colonies were placed in a 96 well dish with 200 μl of SD-medium, leaving wells 1 and 96 blank. Ten microliters from the first 96 well dish was plated into another flat bottom 96 well dish containing 100 μl of SD-medium. Controls consisted of a negative control and a very weak positive control. The cell density was measured at $OD_{600}$ (a value of 1 corresponds to $1\times10^7$ cells utilizing a 96 well spectrophotometer). The OD was usually between 0.03 and 0.10. Using microplates specifically for the luminometer, 50 μl of reaction mixture were pipetted into each well. Fifty microliters of culture were then added and mixed by pipetting up and down twice. The reaction was incubated for 30 minutes at room temperature followed by measurement of Relative Light Units using a luminometer.

Table 9 lists the genes identified in the yeast two hybrid screens from the 3 prey libraries tested. Two genes, zyxin and axin, were found to interact with the cytoplasmic domain of (LRP5) 1 in all three screens. Three genes, alpha-actinin, TCB and SI-5 interacted in two of the three screens.

A variety of proteins found at sites of cell-cell and cell-matrix contact (focal contacts/adesion plaques) were shown to interact with the cytoplasmic domain of Zmax1 (LRP5). These include α-actinin, Trio, Pinch-like protein, and Zyxin. PINCH is a LIM domain-containing protein that is known to interact with integrin-linked kinase, an early signaler in integrin and growth factor signaling pathways. The finding of a closely related gene in the yeast two hybrid screen raises the possibility of a novel pathway linked to integrin signaling from extracellular matrix signals. Trio, also known to localize to focal adhesions, is thought to play a key role in coordinating cell-matrix interactions and cytoskeletal rearrangements involved in cell movement. Zyxin, another LIM domain-containing protein, is also localized to adhesion plaques and is thought to be involved in reorganization of the cytoskeleton when triggers are transmitted via integrin signaling pathways. Zyxin also interacts with alpha actinin, which we identified as interacting with Zmax1 (LRP5). Other LIM domain containing proteins identified include the human homologue of mouse ajuba, LIMD1, and a novel LIMD1-like protein.

Figure 15:
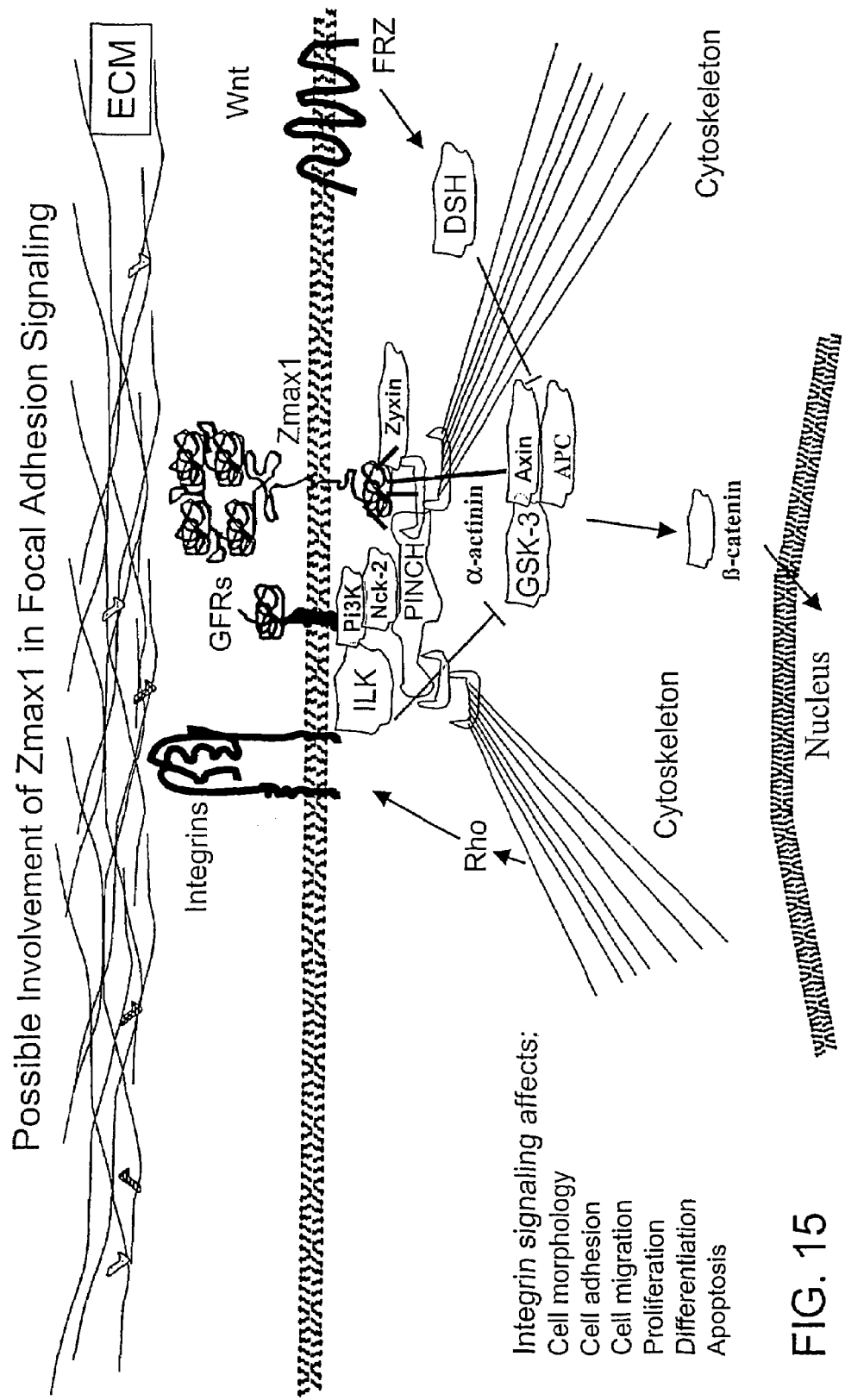
FIG. 15 depicts a model representing the potential role of Zmax1 (LRP5) in focal adhesion signaling.

Axin was also identified from the two hybrid experiments. This protein is involved in inhibition of the Wnt signaling pathway and interacts with the tumor suppressor APC. There is a link here with the focal adhesion signaling described above: one common step in the two pathways involves inhibition of glycogen synthase kinase 3, which in turn results in the activation of β-catenin/Lef-1 and AP-1 transcription factors. Axin/APC are involved in this as well as integrin linked kinase. The Wnt pathway has a role in determining cell fates during embryogenesis. If inappropriately activated, the Wnt pathway may also lead to cancer. The Wnt pathway also seems to have a role in cytoskeletal rearrangements. In a Xenopus embryo assay, the combination of HBM and Wnt5a proteins stimulated the Wnt pathway to a much greater extent than the combination of Zmax1 (LRP5) and Wnt5a, which was modestly above the control and Wnt5a alone scores. The HBM and Zmax1 (LRP5) extracellular domains (ECD) caused a modest stimulation of Wnt signaling in the absence of Wnt5a which was slightly increased by the presence of Wnt5a in the presence of HBM ECD. A model depicting Zmax1 (LRP5) involvement in focal adhesion signaling is depicted in FIG. 15.

This data coupled with other studies suggest that integrin signaling pathways have a role in cellular responses to mechanical stress and adhesion. This provides an attractive model for the mechanism of action of Zmax1 (LRP5) in bone biology. It is possible that Zmax1 (LRP5) is involved in sensing either mechanical stress directly or binding a molecule in the extracellular matrix that is related to mechanical sensation. Signaling through subsequent pathways may be involved in bone remodeling due to effects on cell morphology, cell adhesion, migration, proliferation, differentiation, and apoptosis in bone cells.

TABLE 10

Yeast Two Hybrid Results

| Gene Symbol | Gene | Genbank Accession # | NT SEQ ID NO: | AA SEQ ID NO: |
|---|---|---|---|---|
| ACTN1 | alpha-actinin | NM_001102 | 642 | |
| AES | amino-terminal enhancer of | NM_001130.3 | 643 | |
| AIP4 | atrophin-1 interacting protein | AF038564.1 | 644 | |
| Novel | Ajuba | | 645 | |
| AXIN | Wnt signaling | AF009674.1 | 646 | |
| CDC23 | cell division cycle 23, yeast, homolog | NM_004661.1 | 647 | |
| HSM800944 | Similar to TRIO | AL117435.1 | 748 | |
| HSM800936 | | AL117427.1 | 649 | |
| Novel | Similar to LIM domains containing protein 1 | | 650 | |
| DEEPEST | mitotic spindle coiled-coil related protein | NM_006461.1 | 651 | |
| ECM1 | extracellular matrix protein 1 | U65932.1 | 652 | |
| EF1A | elongation factor 1-alpha | X16869.1 | 653 | |
| FN | fibronectin | X02761.1 | 654 | |
| HOXB13 | homeodomain protein | U81599.1 | 655 | |
| Novel | Glu-Lys Rich protein | | 656 | |
| LIMD1 | LIM domains containing 1 | NM_014240.1 | 657 | |
| Novel | PINCH-like | | 658 | |
| RANBPM | centrosomal protein | NM_005493.1 | 659 | |
| S1-5 | extracellular protein | U03877.1 | 660 | |
| TCB | gene encoding cytosolic thyroid hormone-binding | M26252.1 | 661 | |
| TID | tumorous imaginal discs | NM_005147.1 | 662 | |
| ZYX | Zyxin | NM_003461.1 | 663 | |
| TRIO | GTPase | U42390.1 | 664 | |
| HUMPITPB | phosphatidylinositol transfer protein | D30037.1 | 665 | |
| ACTN1 | alpha-actinin | NP_001093.1 | | 666 |
| AES | amino-terminal enhancer of | NP_001121.2 | | 667 |
| AIP4 | atrophin-1 interacting protein | AAC04845.1 | | 668 |
| Novel | Ajuba | | | 669 |
| AXIN | Wnt signaling | AAC51624.1 | | 670 |
| CDC23 | cell division cycle 23, yeast homolog | NP_004652.1 | | 671 |
| Novel | Similar to TRIO CAB55923.1 | | | 672 |
| Novel | Similar to LIM domains containing protein 1 | | | 673 |
| DEEPEST | mitotic spindle coiled-coil related protein | NP_006452.1 | | 674 |
| ECM1 | extracellular matrix protein 1 | AAB05933.1 | | 675 |
| EF1A | elongation factor 1-alpha | CAA34756.1 | | 676 |
| FN | fibronectin | CAA26536.1 | | 677 |
| Novel | Glu-Lys rich protein | | | 678 |
| HOXB13 | homeodomain protein B13 | AAB39863.1 | | 679 |
| LIMD1 | LIM domains containing 1 | NP_055055.1 | | 680 |
| Novel | PINCH-like | | | 681 |
| RANBPM | centrosomal protein | NP_005484.1 | | 682 |
| S1-5 | extracellular protein | AAA65590.1 | | 683 |
| TCB | cytosolic thyroid hormone-binding protein | AAA36672.1 | | 684 |
| TID | tumorous imaginal discs | NP_005138.1 | | 685 |
| ZYX | Zyxin | NP_003452.1 | | 686 |
| TRIO | GTPase | AAC34245.1 | | 687 |
| PTDINSTP | phosphatidylinositol transfer protein beta isoform | P48739 | | 688 |

In light of the model depicted in FIG. 15 and the results shown in Table 10, another aspect contemplated by the invention would be to regulate bone density and bone mass disorders by the regulating focal adhesion signaling. The regulation can occur by regulating the DNA, mRNA transcript or protein encoded by any of the members involved in the focal adhesion signaling pathway as identified by the yeast two hybrid system.

Also contemplated are the novel nucleic acids and proteins identified by the HBM yeast two hybrid system. These include but are not limited to SEQ ID NO: 645 (Ajuba), SEQ ID NO: 651 (a gene similar to a gene encoding LIM domains containing protein 1), SEQ ID NO: 656 (Glu-Lys Rich protein), SEQ ID NO: 658. (PINCH-like gene), SEQ ID NO: 669 (Ajuba protein), SEQ ID NO: 672 (protein similar to TRIO), SEQ ID NO: 673, SEQ ID NO: 678 (Glu-Lys rich protein) and SEQ ID NO: 681 (PINCH-like protein).

17. Potential Function

The protein encoded by Zmax1 (LRP5) and LRP6 are related to the Low Density Lipoprotein receptor (LDL receptor). See, Goldstein et al., 1985 *Ann. Rev. Cell Biology*, 1: 1-39; Brown et al., 1986 *Science*, 232:34-47. The LDL receptor is responsible for uptake of low density lipoprotein, a lipid-protein aggregate that includes cholesterol. Individuals with a defect in the LDL receptor are deficient in cholesterol removal and tend to develop artherosclerosis. In addition, cells with a defective LDL receptor show increased production of cholesterol, in part because of altered feedback regulation of cholesterol synthetic enzymes and in part because of increased transcription of the genes for these enzymes. In some cell types, cholesterol is a precursor for the formation of steroid hormones.

Thus, the LDL receptor may, directly or indirectly, function as a signal transduction protein and may regulate gene expression. Because Zmax1 (LRP5) and LRP6 are related to the LDL receptor, this protein may also be involved in signaling between cells in a way that affects bone remodeling.

The glycine 171 amino acid is likely to be important for the function of Zmax1 (LRP$^5$) because this amino acid is also found in the mouse homologue of Zmax1 (LRP5). The closely related LRP6 (Genbank Accession No. JB0272) protein also contains glycine at the corresponding position (Brown et al., 1988 *Biochem. Biophys. Res. Comm.* 248: 879-88). Amino acids that are important in a protein's structure or function tend to be conserved between species, because natural selection prevents mutations with altered amino acids at important positions from arising.

In addition, the extracellular domain of Zmax1 (LRP5) contains four repeats consisting of five YWTD motifs (5YWTD disclosed as SEQ ID NO: 1088) followed by an EFG motif. This 5YWTD+EGF repeat (5YWTD disclosed as SEQ ID NO: 1088) is likely to form a distinct folded protein domain, as this repeat is also found in the LDL receptor and other LDL receptor-related proteins. The first three 5YWTD+EGF repeats (5YWTD disclosed as SEQ ID NO: 1088) are very similar in their structure, while the fourth is highly divergent. Glycine 171 occurs in the central YWTD (YWTD disclosed as SEQ ID NO: 1087) motif of the first 5YWTD+EGF repeats(5YWTD disclosed as SEQ ID NO: 1088) in Zmax1 (LRP5). The other two similar 5YWTD+EGF repeats (5YWTD disclosed as SEQ ID NO: 1088) of Zmax1 (LRP5) also contain glycine at the corresponding position, as does the 5YWTD+EGF repeat (5YWTD disclosed as SEQ ID NO: 1088) in the LDL receptor protein. However, only 17.6% of the amino acids are identical among the first three 5YWTD+EGF repeats (5YWTD disclosed as SEQ ID NO: 1088) in Zmax1 (LRP5) and the single repeat in the LDL receptor. These observations indicate that glycine 171 is essential to the function of this repeat, and mutation of glycine 171 causes a functional alteration of Zmax1 (LRP5). The cDNA and peptide sequences are shown in FIGS. 6A-6J. The critical base at nucleotide position 582 is indicated in bold and is underlined.

Figures 7A, 7B:
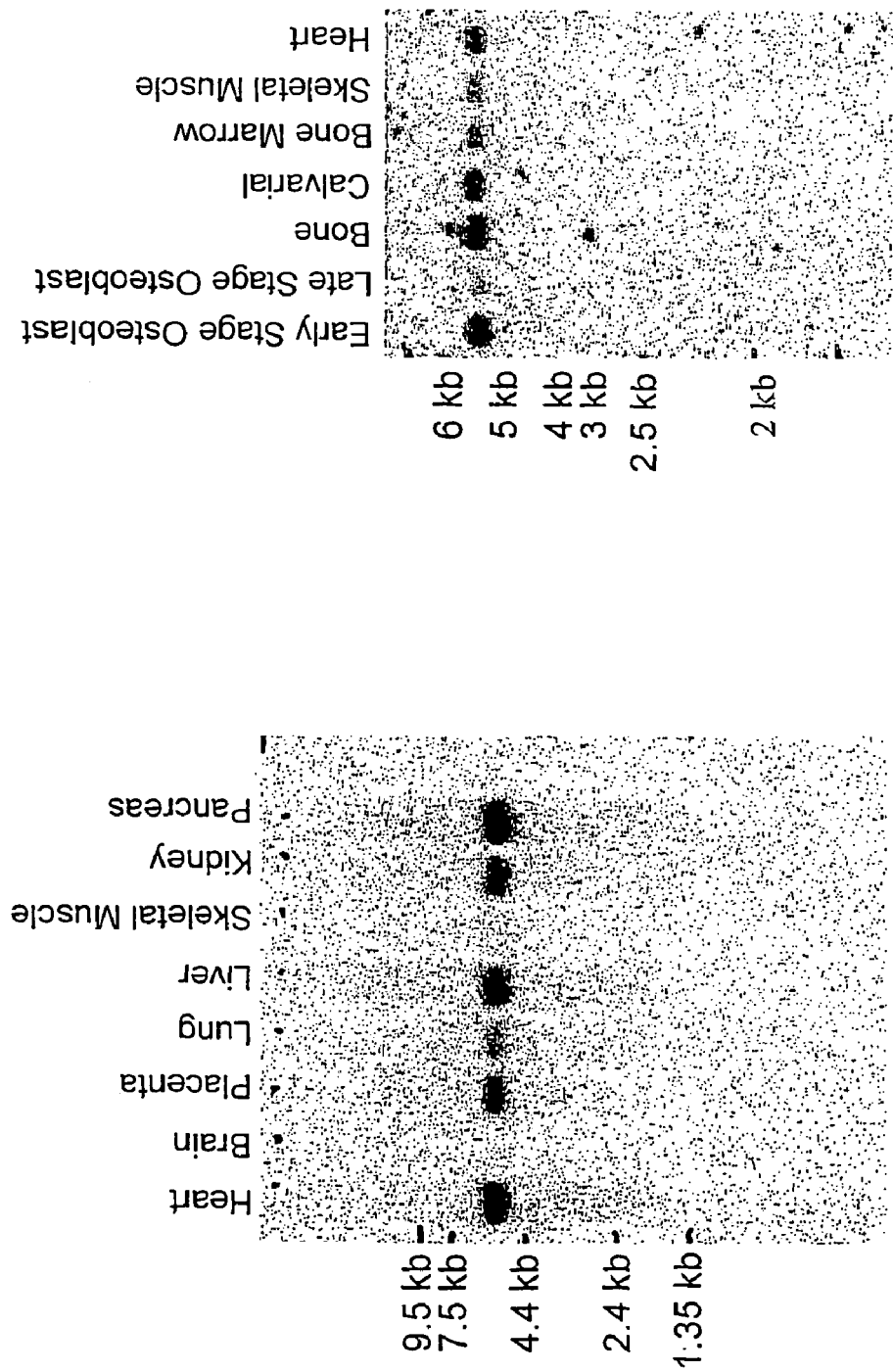
FIGS. 7A and 7B are northern blot analyses showing the expression of Zmax1 (LRP5) in various tissues.
Figure 8:
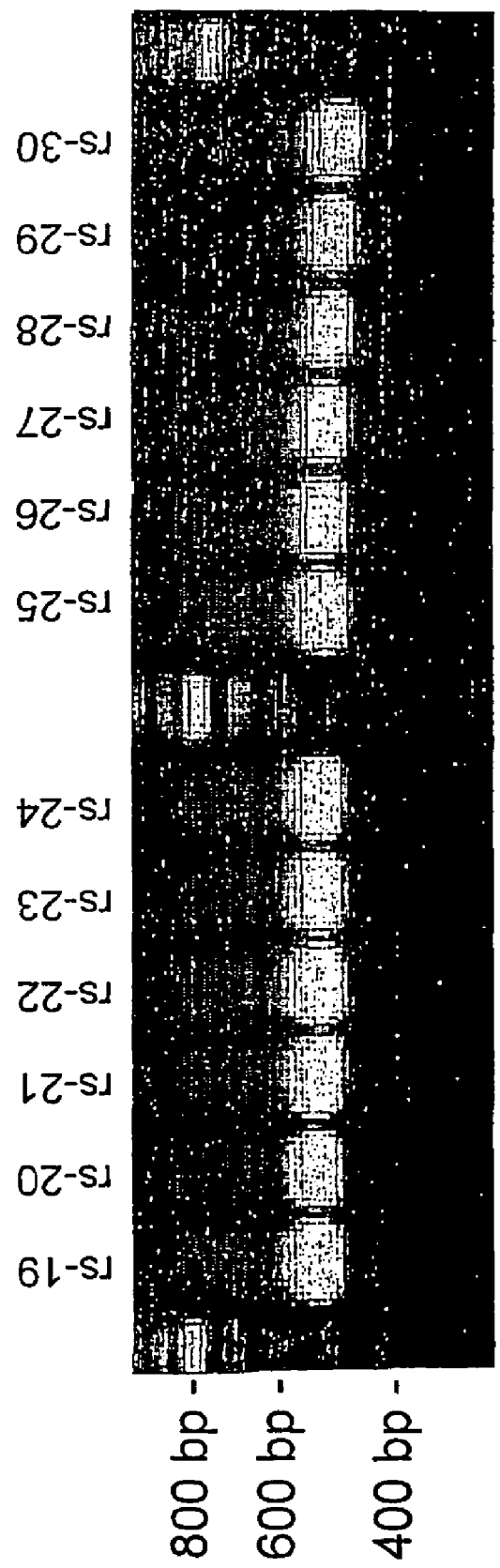
FIG. 8 is a PCR product analysis.

Northern blot analysis (FIGS. 7A-B) reveals that Zmax1 (LRP5) is expressed in human bone tissue as well as numerous other tissues. A multiple-tissue Northern blot (Clontech, Palo Alto, Calif.) was probed with exons from Zmax1 (LRP5). As shown in FIG. 7A, the 5.5 kb Zmax1 (LRP5) transcript was highly expressed in heart, kidney, lung, liver and pancreas and is expressed at lower levels in skeletal muscle and brain. A second northern blot, shown in FIG. 7B, confirmed the transcript size at 5.5 kb, and indicated that Zmax1 (LRP5) is expressed in bone, bone marrow, calvaria and human osteoblastic cell lines.

Taken together, these results coupled with the yeast two hybrid results indicate that the KBM polymorphism in the Zmax1 (LRP5) gene is responsible for the HBM phenotype, and that the Zmax1 gene is important in bone development. In addition, because mutation of Zmax1 can alter bone mineralization and development, it is likely that molecules that bind to Zmax1 may usefully alter bone development. Such molecules may include, for example, small molecules, proteins, RNA aptamers, peptide aptamers, and the like.

18. Preparation of Nucleic Acids. Vectors, Transformations and Host Cells

Large amounts of the nucleic acids of the present invention may be produced by replication in a suitable host cell. Natural or synthetic nucleic acid fragments coding for a desired fragment will be incorporated into recombinant nucleic acid constructs, usually DNA constructs, capable of introduction into and replication in a prokaryotic or eukaryotic cell. Usually the nucleic acid constructs will be suitable for replication in a unicellular host, such as yeast or bacteria, but may also be intended for introduction to (with and without integration within the genome) cultured mammalian or plant or other eulcaryotic cell lines. The purification of nucleic acids produced by the methods of the present invention is described, for example, in Sambrook et al., *Molecular Cloning*. A Laboratory Manual, 2nd Ed. Cold Spring Harbor Laboratory, Cold Spring Harbor, N.Y. (1989) or Ausubel et al., *Current Protocols in Molecular Biology*, J. Wiley and Sons, NY (1992).

The nucleic acids of the present invention may also be produced by chemical synthesis, e.g., by the phosphoramidite method described by Beaucage et al., 1981 *Tetra. Lett.* 22: 1859-62 or the triester method according to Matteucci,et al, 1981 *J. Am. Chem. Soc.* 103: 3185, and may be performed on commercial, automated oligonucleotide synthesizers. A double-stranded fragment may be obtained from the single-stranded product of chemical synthesis either by synthesizing the complementary strand and annealing the strands together under appropriate conditions or by adding the complementary strand using DNA polymerase with an appropriate primer sequence.

Nucleic acid constructs prepared for introduction into a prokaryotic or eukaryotic host may comprise a replication system recognized by the host, including the intended nucleic acid fragment encoding the desired protein, and will preferably also include transcription and translational initiation regulatory sequences operably linked to the protein encoding segment. Expression vectors may include, for example, an origin of replication or autonomously replicating sequence (ARS) and expression control sequences, a promoter, an enhancer and necessary processing information sites, such as ribosome-binding sites, RNA splice sites, polyadenylation sites, transcriptional terminator sequences, and mRNA stabilizing sequences. Secretion signals may also be included where appropriate, whether from a native HBM or Zmax1 (LRP5) protein or from other receptors or from secreted proteins of the same or related species, which allow the protein to cross and/or lodge in cell membranes, and thus attain its functional topology, or be secreted from the cell. Such vectors may be prepared by means of standard recombinant techniques well known in the art and discussed, for example, in Sambrook et al., (1989) or Ausubel et al., (1992).

An appropriate promoter and other necessary vector sequences will be selected so as to be functional in the host, and may include, when appropriate, those naturally associated with Zmax1 (LRP5) or HBM genes. Examples of workable combinations of cell lines and expression vectors are described in Sambrook et al., (1989) or Ausubel et al., (1992). Many useful vectors are known in the art and may be obtained from such vendors as Stratagene, New England BioLabs, Promega Biotech, and others. Promoters such as the trp, lac and phage promoters, tRNA promoters and glycolytic enzyme promoters may be used in prokaryotic hosts. Useful yeast promoters include promoter regions for metallothionein, 3-phosphoglycerate kinase or other glycolytic enzymes such as enolase or glyceraldehyde-3-phosphate dehydrogenase, enzymes responsible for maltose and galactose utilization, and others. Vectors and promoters suitable for use in yeast expression are further described in EP 73,675A. Appropriate non-native mammalian promoters might include the early and late promoters from SV40 (Fiers et al., 1978 *Nature* 273: 113) or promoters derived from murine Moloney leukemia virus, mouse tumor virus, avian sarcoma viruses, adenovirus H, bovine papilloma virus or polyoma. In addition, the construct may be joined to an amplifiable gene (e.g., DHFR) so that multiple copies of the gene may be made. For appropriate enhancer and other expression control sequences, see also *Enhancers and Eukaiyotic Gene Expression*, Cold Spring Harbor Press, Cold Spring Harbor, NY (1983).

While such expression vectors may replicate autonomously, they may also replicate by being inserted into the genome of the host cell, by methods well known in the art.

Expression and cloning vectors will likely contain a selectable marker, a gene encoding a protein necessary for survival or growth-of a host cell transformed with the vector. The presence of this gene ensures growth of only those host cells which express the inserts. Typical selection genes encode proteins that a) confer resistance to antibiotics or other toxic substances, e.g. ampicillin, neomycin, methotrexate, etc.; b) complement auxotrophic deficiencies, or c) supply critical nutrients not available from complex media, e.g., the gene encoding D-alanine racemase for Bacilli. The choice of the proper selectable marker will depend on the host cell, and appropriate markers for different hosts are well known in the art.

The vectors containing the nucleic acids of interest can be transcribed in vitro, and the resulting RNA introduced into the host cell by well-known methods, e.g., by injection (see, Kubo et al., *FEBS Letts.* 241: 119 (1988)), or the vectors can be introduced directly into host cells by methods well known in the art, which vary depending on the type of cellular host, including electroporation; transfection employing calcium chloride, rubidium chloride, calcium phosphate, DEAE-dextran, or other substances; microprojectile bombardment; lipofection; infection (where the vector is an infectious agent, such as a retroviral genome); and other methods. See generally, Sambrook et al., 1989 and Ausubel et al., 1992. The introduction of the nucleic acids into the host cell by any method known in the art, including those described above, will be referred to herein as "transformation." The cells into which have been introduced nucleic acids described above are meant to also include the progeny of such cells.

Large quantities of the nucleic acids and proteins of the present invention may be prepared by expressing the Zmax1 (LRP5), LRP6, HBM or HBM-like nucleic acids or portions thereof in vectors or other expression vehicles in compatible prokaryotic or eukaryotic host cells. The most commonly used prokaryotic hosts are strains of *Escherichia coli*, although other prokaryotes, such as *Bacillus subtilis* or *Pseudolilonas* may also be used.

Mammalian or other eukaryotic host cells, such as those of yeast, filamentous fungi, plant, insect, or amphibian or avian species, may also be useful for production of the proteins of the present invention. Propagation of mammalian cells in culture is per se well known. See, Jakoby and Pastan (eds.), *Cell Culture. Methods in Enzymology*, volume 58, Academic Press, Inc., Harcourt Brace Jovanovich, N.Y., (1979). Examples of commonly used mammalian host cell lines are VERO and HeLa cells, Chinese hamster ovary (CHO) cells, and WI38, BHK, and COS cell lines, although it will be appreciated by the skilled practitioner that other cell lines may be appropriate, e.g., to provide higher expression desirable glycosylation patterns, or other features.

Clones are selected by using markers depending on the mode of the vector construction. The marker may be on the same or a different DNA molecule, preferably the same DNA molecule. In prokaryotic hosts, the transformant may be selected, e.g., by resistance to ampicillin, tetracycline or other antibiotics. Production of a particular product based on temperature sensitivity may also serve as an appropriate marker.

Prokaryotic or eukaryotic cells transformed with the nucleic acids of the present invention will be useful not only for the production of the nucleic acids and proteins of the present invention, but also, for example, in studying the characteristics of Zmax1 (LRP5), LRP6, HBM or HBM-like proteins.

Antisense nucleic acid sequences are useful in preventing or diminishing the expression of Zmax1 (LRP5), LRP6, HBM or HBM-like molecules, as will be appreciated by one skilled in the art. For example, nucleic acid vectors containing all or a portion of the Zmax1 (LRP5), LRP6, HBM or HBM-like nucleic acid may be placed under the control of a promoter in an antisense orientation and introduced into a cell. Expression of such an antisense construct within a cell will interfere with Zmax1 (LRP5), LRP6, HBM or HBM-like transcription and/or translation and/or replication.

The probes and primers based on the Zmax1 (LRP5), LRP6, HBM or HBM-like gene sequences disclosed herein are used to identify homologous gene sequences and proteins in other species. The gene sequences and proteins can also be used in the diagnostic/prognostic, therapeutic and drug screening methods described herein for the species from which they have been isolated.

19. Protein Expression and Purification

Expression and purification of the Zmax1 (LRP5), LRP6, HBM or HBM-like proteins of the invention can be performed essentially as outlined below (LRP5, LRP6 and HBM-like proteins are also included when referring only to HBM). To facilitate the cloning, expression and purification of membrane and secreted protein from the HBM gene, a gene expression system, such as the pET System (Novagen), for cloning and expression of recombinant proteins in *E. coli* was selected. Also, a DNA sequence encoding a peptide tag, the His-Tap, was fused to the 3' end of DNA sequences of interest to facilitate purification of the recombinant protein products. The 3' end was selected for fusion to avoid alteration of any 5' terminal signal sequence.

Nucleic acids chosen, for example, from the nucleic acids set forth in SEQ ID NOS: 1, 3 and 5-11 for cloning HBM were prepared by polymerase chain reaction (PCR). Synthetic oligonucleotide primers specific for the 5' and 3' ends of the HBM nucleotide sequence were designed and purchased from Life Technologies (Gaithersburg, Md.). All forward primers (specific for the 5' end of the sequence) were designed to include an NcoI cloning site at the 5' terminus. These primers were designed to permit initiation of protein translation at the methionine residue encoded within the NcoI site followed by a valine residue and the protein encoded by the HBM DNA sequence. All reverse primers (specific for the 3' end of the sequence) included an EcoRI site at the 5' terminus to permit cloning of the HBM sequence into the reading frame of the pET-28b. The pET-28b vector provided a sequence encoding an additional 20 carboxyl-terminal amino acids including six histidine residues (at the C-terminus), which comprised the histidine affinity tag.

Genomic DNA prepared from the HBM gene was used as the source of template DNA for PCR amplification (Ausubel et al., *Current Protocols in Molecular Biology*, John Wiley & Sons (1994)). To amplify a DNA sequence containing the HBM nucleotide sequence, genomic DNA (50 ng) was introduced into a reaction vial containing 2 mM $MgCl_2$, 1 μM synthetic oligonucleotide primers (forward and reverse primers) complementary to and flanking a defined HBM, 0.2 mM of each of deoxynucleotide triphosphate, dATP, dGTP, dCTP, dTTP and 2.5 units of heat stable DNA polymerase (Ampli-Taq™, Roche Molecular Systems, Inc., Branchburg, N.J.) in a final volume of 100 microliters.

Upon completion of thermal cycling reactions, each sample of amplified DNA was purified using the Qiaquick Spin PCR purification kit (Qiagen, Gaithersburg, Md.). All amplified DNA samples were subjected to digestion with the restriction endonucleases, e.g., NcoI and EcoRI (New England BioLabs, Beverly, Mass.) (Ausubel et al., *Current Protocols in Molecular Biology*, John Wiley & Sons, Inc. (1994)). DNA samples were then subjected to electrophoresis on 1.0% NuSeive (FMC BioProducts, Rockland, Md.) agarose gels. DNA was visualized by exposure to ethidium bromide and long wave UV irradiation. DNA contained in slices isolated from the agarose gel was purified using the Bio 101 GeneClean Kit protocol (Bio 101, Vista, Calif.).

The pET-28b vector was prepared for cloning by digestion with restriction endonucleases, e.g., NcoI and EcoRI (New England BioLabs, Beverly, Mass.) (Ausubel et al., *Current Protocols in Molecular Biology*, John Wiley & Sons, inc. (1994)). The pET-28a vector, which encodes the histidine affinity tag that can be fused to the 5' end of an inserted gene, was prepared by digestion with appropriate restriction endonucleases.

Following digestion, DNA inserts were cloned (Ausubel et al., *Current Protocols in Molecular Biology*, John Wiley & Sons, Inc. (1994)) into the previously digested pET-28b expression vector. Products of the ligation reaction were then used to transform the BL21 strain of *E. coli* (Ausubel et al., 1994) as described below.

Competent bacteria, *E. coli* strain BL21 or *E. coli* strain BL21 (DE3), were transformed with recombinant pET expression plasmids carrying the cloned HBM sequence according to standard methods (Ausubel et al., 1994). Briefly, 1 μl of ligation reaction was mixed with 50 μl of electrocompetent cells and subjected to a high voltage pulse, after which samples were incubated in 0.45 ml SOC medium (0.5% yeast extract, 2.0% tryptone, 10 mM NaCl, 2.5 mM KCl, 10 mM MgCl$_2$, 10 mM MgSO$_4$ and 20 mM glucose) at 37° C. with shaking for 1 hour. Samples were then spread on LB agar plates containing 25 µg/ml kanamycin sulfate for growth overnight. Transformed colonies of BL21 were then picked and analyzed to evaluate cloned inserts, as described below.

Individual BL21 clones transformed with recombinant pET-28b HBM nucleotide sequences were analyzed by PCR amplification of the cloned inserts using the same forward and reverse primers specific for the HBM sequences that were used in the original PCR amplification cloning reactions. Successful amplification verifies the integration of the HBM sequence in the expression vector (Ausubel et al., 1994).

Individual clones of recombinant pET-28b vectors carrying properly cloned HBM nucleotide sequences were picked and incubated in 5 ml of LB broth plus 25 µg/ml. kanamycin sulfate overnight. The following day plasmid DNA was isolated and purified using the Qiagen plasmid purification protocol (Qiagen Inc., Chatsworth, Calif.).

The pET vector can be propagated in any *E. coli* K-12 strain, e.g., HMS174, HB101, JM109, DH5 and the like, for purposes of cloning or plasmid preparation. Hosts for expression include *E. coli* strains containing a chromosomal copy of the gene for T7 RNA polymerase. These hosts were lysogens of bacteriophage DE3, a lambda derivative that carries the lacI gene, the lacUV5 promoter and the gene for T7 RNA polymerase. T7 RNA polymerase was induced by addition of isopropyl-β-D-thiogalactoside (IPTG), and the T7 RNA polymerase transcribes any target plasmid containing a functional T7 promoter, such as pET-28b, carrying its gene of interest. Strains include, for example, BL21(DE3) (Studier et al., 1990 *Meth. Enzymol.*, 185: 60-89).

To express the recombinant HBM sequence, 50 ng of plasmid DNA are isolated as described above to transform competent BL21(DE3) bacteria as described above (provided by Novagen as part of the pET expression kit). The lacZ gene (β-galactosidase) is expressed in the pET-System as described for the HBM recombinant constructions. Transformed cells were cultured in SOC medium for 1 hour, and the culture was then plated on LB plates containing 25 µg/ml kanamycin sulfate. The following day, the bacterial colonies were pooled and grown in LB medium containing kanamycin sulfate (25 µg/ml) to an optical density at 600 nM of 0.5 to 1.0 O.D. units, at which point 1 mM IPTG was added to the culture for 3 hours to induce gene expression of the HBM recombinant DNA constructions.

After induction of gene expression with IPTG, bacteria were collected by centrifugation in a Sorvall RC-3B centrifuge at 3500×g for 15 minutes at 4° C. Pellets were resuspended in 50 ml of cold mM Tris-HCl, pH 8.0, 0.1 M NaCl and 0.1 mM EDTA (STE buffer). Cells were then centrifuged at 2000×g for 20 minutes at 4° C. Wet pellets were weighed and frozen at –80° C. until ready for protein purification.

19.1 Chinese Hamster Ovary (CHO) Expression System

Alternatively, HBM and Zmax1 (LRP5) may be expressed in eukaryotic cells. Eukaryotic cells, such as mammalian derived cell lines, are more capable of expressing properly folded proteins containing cystine rich domains such as the EGF and LDLR modules.

19.2 Development of Constructs

HBM and Zmax1 (LRP5) extracellular domain fusions (ECD) to IgG-Fc were prepared. These ECD fusions to the IgG-Fc domain remove the endogenous transmembrane and cytoplasmic portion of the Zmax1/HBM receptor and should produce a secreted fusion protein. The Fc region is separated from the Zmax1/HBM ECD by an enterokinase recognition site so that purified Zmax1 or HBM ECD protein can be obtained without the Fc domain present. The vector used for this construct was pHTop, a derivative of pED (Kaufinan et al., 1991 *Nuc. Acids Res.* 19: 4485-90) in which the majority of the adenomajor late promoter was replaced by six repeats of the tet operator (Gossen et al., 1992 *Proc. Natl. Acad. Sci. USA* 89: 5547-51). This vector contains the dihydrofolate reductase (dhfr) gene, and when introduced in the cell line CHO/A2 (see description below), functions very efficiently. Clones with high expression can be selected by isolating cells which survive in high methotrexate (MTX) concentrations.

The CHO expression vector pHTOP-Fc was digested with SalI and NotI. The intervening sequence was purified away from the rest of the vector by electroelution from an acrylamide gel slice. SalI cuts 5' to the intrinsic honey bee mellitin signal sequence in pHTOP-Fc, and NotI cuts just 5' to the coding sequence IgG1-Fc. The resulting SalI-NotI pHTOP-Fc vector has the signal sequence removed and the NotI cloning site is amenable to creating a 5' fusion to IgG-Fc. Full-length Zmax1 (LRP5) in pCMVSPORT6 and full-length HBM in pCMVSPORT6 were digested individually with Xma1 which cuts within the region of the ORF that encodes the signal sequence) and BamHI (that cuts internally in the ORF) to generate a 2286 bp 5' fragment of Zmax1 and HBM. The mutation which distinguishes Zmax1 from HBM lies on this fragment. Separately, the Zmax1 DNA was digested with BamHI and SacI to isolate an 1800 bp 3' fragment which is common to both the Zmax1 and the HBM genes. Together, these two fragments constitute the coding sequence for the HBM and Zmax1 extracellular domains, less the coding sequence for the first 6 amino acids of the signal sequence and ending 18 amino acids prior to the end of the extracellular domain, which we estimated from Kyte-Doolittle plots to end at the sequence "SPAHSS" (SEQ ID NO:698).

A synthetic duplex was designed to recreate the coding sequence of the Zmax1/HBM signal sequence 5' of the native Xma1 site, which included the initiator methionine and Kozak sequence. This duplex was designed to contain SalI (5') and XmaI (3') cohesive ends to adapt ends to adapt the gene fragments described above to the pHTOP-Fc vector. This synthetic duplex was constructed from two partially complementary oligonucleotides as given below:

5'-TCGACCACCATGGAGGCAGCGCCGC-3'   (SEQ ID NO:699)

3'-GGTGGTACCTCCGTCGCGGCGGGCC-5'   (SEQ ID NO:700)

A second synthetic duplex was designed to recreate the 3' coding sequence from a native SacI site to the estimated end of the extracellular domain following the serine in the sequence ". . . SPAHSS" (SEQ ID NO: 698), and to also encode a cloning site to allow in-frame fusion to the downstream IgG-Fc. This duplex was designed to contain SacI (5') and NotI (3') cohesive ends to adapt the gene fragments described above to the pHTOP-Fc vector. This synthetic duplex was constructed from two partially complementary oligonucleotides whose sequences are given below:

5'-CATGTGTGAAATCACCAAGCCGCCCTCA   (SEQ ID NO:701)
GACGACAGCCCGGCCCACAGCAGTGGC-3'

3'-TCGAGTACACACTTTAGTGGTTCGGCGG   (SEQ ID NO:702)
GAGTCTGCTGTC GGGCCGGGTGTCGTCACCGCCGG-5'

The fragments, synthetic duplexes, and vector were ligated together in a single reaction. Separate reactions were performed for Zmax (LRP5) 1 and HBM. The ligation mixtures were used to transform electrocompetent E. coli DH10B cells, and the resulting colonies were screened by radioactive colony hybridization using the common SacI-BamHI 3' fragment as a probe. Colonies containing plasmids with the Zmax1 or HBM fragment inserted were identified, and plasmids were isolated from multiple candidates and their sequences were verified by DNA sequencing. Verified constructs were then used for transfection into CHO cells.

19.2.1 Establishment of CHO Stable Cell Lines

The CHO/A2 cell line is derived from CHO DUKX B11 (Urlaub et al., 1980 Proc. Natl. Acad. Sci. USA 77: 4216-20) by stably integrating a transcriptional activator (tTA), a fusion protein, between the Tet repressor and the herpes virus VP16 transcriptional domain (Gossen et al.) CHO cell lines expressing extracellular HBM-1.Fc and Zmax1.Fc were established by transfecting (using lipofection) pHTopHBM-1.Fc into CHO/A2 cells and pHTopZmax1.Fc into CHO/A2 cells. Clones were selected using by culturing the cells in 0.02 µM methotrexate. Clones were later amplified step-wise to a final concentration of 0.5 µM methotrexate.

19.2.2 Screening of CHO Stable Cell Lines

Multiple clones were screened by a variety of techniques. Clones were screened by Western blot assay using a (mouse) anti-human IgG.Fc horseradish peroxidase (RP) antibody. The same clones were also metabolically labeled with $^{35}$S-Met/Cys) for a 6 hour pulse, or a 15 minute pulse, followed by a 1 hour, 4 hour, or 24 hour chase in media without radiolabeled Met/Cys. Immunoprecipitations were performed on proteins obtained from conditioned media, as well as from cell extracts. Purification is then performed followed by sequencing of the proteins using N-terminal sequencing as known in the art.

19.2.3 Fusion Protein Purification

Zmax1-IgG or HBM-IgG fusion protein can be purified from conditioned media or cell extracts of CHO stable cells. The fusion protein is isolated by affinity binding to protein A (for example using protein A coated beads or columns). The IgG-FC domain can then subsequently be cleaved from the Zmax/HBM1 ECD protein by enterokinase digestion.

19.2.4 Potential Uses for Cell Lines and Protein

Stable cell lines may be used for generation of purified protein for use in ligand hunting, antibody generation, determination of crystal structure, and competitive binding assays.

A variety of methodologies known in the art can be used to purify the isolated proteins (Coligan et al., Current Protocols in Protein Science, John Wiley & Sons (1995)). For example, the frozen cells can be thawed, resuspended in buffer and ruptured by several passages through a small volume microfluidizer (Model M-110S, Microfluidics International Corp., Newton, Mass.). The resultant homogenate is centrifuged to yield a clear supernatant (crude extract) and, following filtration, the crude extract is fractioned over columns. Fractions are monitored by absorbance at $OD_{280}$ nm and peak fractions may be analyzed by SDS-PAGE.

The concentrations of purified protein preparations are quantified spectrophotometrically using absorbance coefficients calculated from amino acid content (Perkins, 1986 Eur. J. Biochem. 157:169-180). Protein concentrations are also measured by the method of Bradford, 1976 Anal. Biochem. 72: 248-54 and Lowry et al., 1951 J. Biol. Chewn. 193: 265-275 using bovine serum albumin as a standard.

SDS-polyacrylamide gels of various concentrations were purchased from BioRad (Hercules, Calif.), and stained with Coomassie blue. Molecular weight markers may include rabbit skeletal muscle myosin (200 kDa), E. coli β-galactosidase (116 kDa), rabbit muscle phosphorylase B (97.4 kDa), bovine serum albumin (66.2 kDa), ovalbumin (45 kDa), bovine carbonic anhydrase (31 kDa), soybean trypsin inhibitor (21.5 kDa), egg white lysozyme (14.4 kDa) and bovine aprotinin (6.5 kDa).

Once a sufficient quantity of the desired protein has been obtained, it may be used for various purposes. A typical use is the production of antibodies specific for binding. These antibodies may be either polyclonal or monoclonal, and may be produced by in vitro or in vivo techniques well known in the art. Monoclonal antibodies to epitopes of any of the peptides identified and isolated as described can be prepared from murine hybridomas (Kohler, 1975 Nature, 256: 495). In summary, a mouse is inoculated with a few micrograms of HBM protein over a period of two weeks. The mouse is then sacrificed. The cells that produce antibodies are then removed from the mouse's spleen. The spleen cells are then fused with polyethylene glycol with mouse myeloma cells. The successfully fused cells are diluted in a microtiter plate and growth of the culture is continued. The amount of antibody per well is measured by immunoassay methods such as ELISA (Engvall, 1980 Meth. Enzymol. 70: 419). Clones producing antibody can be expanded and further propagated to produce HBM antibodies. Other suitable techniques involve in vitro exposure of lymphocytes to the antigenic polypeptides, or alternatively, to selection of libraries of antibodies in phage or similar vectors. See Huse et al., 1989. Science 246: 1275-81. For additional information on antibody production see Davis et al., Basic Methods in Molecular Biology, Elsevier, N.Y., Section 21-2 (1989).

Additional uses for purified or isolated protein includes use in X-ray crystallography, binding assays, and so forth as described in greater detail infra.

19.3 Zmax1, LRP6, and Variant Antibodies

Polyclonal antibodies were developed to both human Zmax1 (LRP5) (SEQ ID NO:3) and LRP6 (GenBank Accession No. AF074264). Antibodies can similarly be prepared against HBM and HBM like proteins and polypeptides. Peptides from the Zmax1 amino acid sequence were selected as immunogens based on five goals. 1) Maximize differences between Zmax1 and LRP6 amino acid sequences (71% amino acid identity). See FIG. 27. For sequence comparison, typically one sequence acts as a reference sequence, to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s), relative to the reference sequence, based on the designated program parameters. 2) Minimize potential cross reactivity with other known genes by performing sequence alignment and similarity searches. Optimal alignment of sequences for comparison can be conducted, e.g., by the local homology algorithm of Smith et al., 1981 Adv. Appl. Math. 2: 482, by the homology alignment algorithm of Needleman et al., 1970 J. Mol. Biol. 48: 443, by the search for similarity method of Pearson et al., 1988 Proc. Natl. Acad. Sci. USA 85: 2444, by computerized implementations of these algorithms and others in programs contained in the Wisconsin genetics software package, Genetics Computer Group, 585 Science Dr., Madison, Wis., or by visual inspection (see generally Ausubel et al., Current Protocols in Molecular Biology, John Wiley & Sons (1997). Another example of algorithm that is suitable for determining percent sequence identity and sequence similarity is the BLAST algorithm, which is described in Altschul et al., 1990 *J. Mol. Biol.* 215: 403-10. Software for performing BLAST analyses is publicly available through the National Center for Biotechnology Information. 3) Obtain peptides with the highest antigenicity index as possible as determined by Peptide-Structure protein analysis using software programs contained in the Wisconsin Genetics software package, Genetics Computer Group, 575 Science Dr., Madison, Wis. 4) Locating peptides relative to highly homologous domains (e.g., EGF-like domains and LDL receptor repeats) within the gene family and the location relative to the extracellular and cytoplasmic regions of the gene. 5) And, for human Zmax1 specific antibodies, the human amino acid sequence (SEQ ID NO: 3) was compared to the mouse Zmax1 sequence (GenBank Accession No. AF064984) and peptides were selected based on the above criteria in addition to minimizing the sequence similarity between the two species (See FIG. 26).

Using the same criteria above, LRP6 specific peptides were selected for polyclonal antibody production. Table 11 lists the amino acid sequences that were chosen, the amino acid differences within the peptide between the human and mouse sequences. Al the peptide sequences (ranging from 12-18 amino acids) were provided to Sigma/Genosys (St. Louis, Mo.) for peptide synthesis and subsequent polyclonal antibody production in New Zealand White Rabbits. The IgG fraction from the serum of each immunized rabbit was isolated using Protein G Sepharose (Amersham). Polyclonal antibody generation using these peptides may be done in other species as well, for example, chickens. This is often advantageous when there is a high degree of similarity between the human (reference) and murine/rodent sequence.

One set of preferred antibodies includes:

| LRP5 Amino Acids | Sequence | |
|---|---|---|
| 208-223 | KLYWADAKLSFIHRAN | (SEQ ID NO:766) |
| 277-291 | ALYSPMDIQVLSQER | (SEQ ID NO:767) |
| 61-73 | GLEDAAAVDFQFSKGA | (SEQ ID NO:768) |
| 234-247 | EGSLTHPFALTLSG | (SEQ ID NO:769) |
| 249-264 | TLYWTDWQTRSIHACN | (SEQ ID NO:770) |
| 144-156 | VLFWQDLDQPRAI | (SEQ ID NO:771) |
| 194-210 | IYWPNGLTIDLEEQKLY | (SEQ ID NO:772) |
| 34-47 | LLLFANRRDVRLVD | (SEQ ID NO:773) |
| 75-89 | GAVYWTDVSEEAIKQ | (SEQ ID NO:774) |
| 121-135 | KLYWTDSETNRIEVA | (SEQ ID NO:775) |

Similar peptides can be used to prepare antibodies based on the LRP6 or HBM structures and the proposed mutations in their propellers. Other antibodies could easily be prepared based on the structural model discussed in the Examples, as would be readily appreciated by the skilled artisan.

Another series of antibodies could be prepared which target the domains on HBM, LRP5, LRP6 and their variants which interact Dkk. Such antibodies could again serve as

TABLE 11

| Amino Acids | Amino Acids | SEQ ID NO | H/M* Differences | Comments |
|---|---|---|---|---|
| 171-187 | VETPRIERAGMDGSTRK | 703 | 5 | Contains HBM polymorphism |
| 264-278 | NKRTGGKRKEILSAL | 704 | 3 | Extracellular |
| 290-301 | ERQPFFHTRCEE | 705 | 2 | Adjacent to EGF-I, extracellular |
| 532-546 | VDGTKRRTLLEDKLP | 706 | 5 | Extracellular |
| 901-915 | DGLNDCMHNNGQCGQ | 707 | 2 | In EGF-III, extracellular |
| 1010-1021 | PFVLTSLSQGQN | 708 | 6 | Extracellular, human specific |
| 1415-1429 | YAGANGPFPHEYVSG | 709 | 3 | Cytoplasmic |
| 1452-1464 | ACGKSMMSSVSLM | 710 | 5 | Cytoplasmic, human specific |
| 1556-1573 | RWKASKYYLDLNSDSDPY | 711 | 1 | Cytoplasmic |
| 888-902 | SGWNECASSNGHCSH | 712 | | LRP6 specific |
| 1308-1321 | NGDANCQDKSDEKN | 713 | | LRP6 specific |

*H/M-differences between human and mouse sequences

Antibodies towards variants of LRP6, HBM and LRP5 are also contemplated. Based on the analysis of the structural model of the LRP5 beta propeller 1 (discussed in more detail in the Examples), interior regions of the propeller were analysed. Since the site-directed mutagenesis experiments had confirmed that modulation of propeller 1, particularly in the interior regions of beta propeller 1, could result in an HBM effect, a strategy was employed to generate antibodies with epitopes specific to these regions. Such antibodies to the wild type LRP5 receptor could serve, for examples, as an HBM mimetic, by altering ligand/receptor interactions, protein-protein interactions, or by modulating Wnt or Dkk activity. Such antibodies could be used as therapies to treat, for example osteoporosis.

HBM mimetics, for example by displacing Dkk binding and thereby could be used as an osteoporosis therapeutic. Preferred peptides for preparing antibodies include but are not limited to:

| LRP5 Amino Acids | Sequence | |
|---|---|---|
| 969-993 | LILPLHGLRNVKAIDYDPLDKFIYW | (SEQ ID NO:943) |
| 989-1013 | KFIYWVDGRQNIKRAKDDGTQPFVL | (SEQ ID NO:944) |

-continued

| LRP5 Amino Acids | Sequence | |
|---|---|---|
| 1009-1033 | QPFVLTSLSQGQNPDRQPHDLSIDI | (SEQ ID NO:945) |
| 1029-1053 | LSIDIYSRTLFWTCEATNTINVHRL | (SEQ ID NO:946) |
| 10491073 | NVHRLSGEAMGVVLRGDRDKPRAIV | (SEQ ID NO:947) |
| 1253-1266 | CGEPPTCSPDQFAC | (SEQ ID NO:948) |
| 1278-1295 | WRCDGFPECDDQSDEEGC | (SEQ ID NO:949) |
| 1316-1332 | RCDGEADCQDRSDEADC | (SEQ ID NO:950) |
| 1370-1383 | CEITKPPSDDSPAH | (SEQ ID NO:951) |

Additional peptides would be readily apparent to the artism of ordinary skill.

19.3.1 Single Chain Fv Molecules Developed by Phage Display

Peptides were chosen from the Zmax1 (LRP5) sequence (SEQ ID NO: 3) to screen for single chain Fv (scFv) molecules by phage display. Similar peptides can be chosen for LRP6, HBM and HBM-like proteins to screen for scFv molecules. As discussed below, all mention of LRP5 is also meant to include these other proteins.

A total of 17 peptides from the Zmax1 sequence were selected for synthesis and subsequent phage display screen for scfv molecules. All peptide synthesis and phage display work was performed at ° Cambridge Antibody Technology (CaT) in Cambridge, UK. Peptides were selected based on criteria as described above.

TABLE 12

| Protein Domain | Zmax1 Residues | LRP6 Residues | % Identity |
|---|---|---|---|
| Spacer 1 (+G171V) | 161-181 | 148-168 | 76% |
| Spacer 1 (−G171V) | 161-181 | 148-168 | 76% |
| EGF 1 | 301-321 | 288-308 | 76% |
| Spacer 2 | 401-421 | 388-408 | 52% |
| EGF 2 | 611-631 | 598-618 | 62% |
| Spacer 3 | 781-801 | 768-788 | 62% |
| EGF 3 | 921-941 | 908-928 | 10% |
| Spacer 4 | 1000-1021 | 988-1008 | 26% |
| EGF 4 | 1229-1249 | 1219-1239 | 76% |
| LDLR 1 | 1261-1282 | 1252-1272 | 81% |
| LDLR 2 | 1300-1320 | 1290-1310 | 57% |
| LDLR 3 | 1338-1358 | 1328-1348 | 48% |
| Cytosolic 1 | 1418-1438 | 1405-1425 | 14% |
| Cytosolic 1 | 1516-1536 | 1503-1525 | 52% |
| Cytosolic 1 | 1535-1555 | 1524-1544 | 81% |
| Cytosolic 1 | 1595-1615 | 1592-1613 | 82% |
| Spacer 2 (cross reactive) | 421-441 | 408-428 | 100% |

Note that a number of these regions (e.g., 401-421, 421-441, 781-801, and 1229-1249) share 100% identity with mouse LRP5 (see FIG. 26). Therefore, these may be used against both mouse and human forms of the protein. The peptide 421-441 was included to facilitate the generation of an antibody that would recognize both Zmax1 (LRP5) and LRP6 (see FIG. 27). Two peptides were synthesized spanning the HBM mutation site (Zmax1 residues 161-181), one with the Zmax1 sequence and the other containing the HBM sequence.

Once scFv molecules were isolated, they were used as reagents in immunochemistry to detect Zmax1 (LRP5) protein expression in a variety of human normal and diseased tissues. The details of the scFV antibody inmmunohistochemical analysis of three phage clones against peptide 1000-1021 (i.e., IKRAKDDGTQPFVLTSLSQGQN; SEQ ID NO: 714) of the extracellular domain of Zmax1 showed positive staining with cardiac muscle, kidney, lung and liver. Expression was also detected in prostate carcinoma. These results are consistent with mRNA tissue distribution profiles as well as with the published reports of LRP5 MRNA localization (Kim et al., 1998 *J. Biochem.* 124: 1072-6). The resulting phage clones arise from pools and will be sequenced to identify potential variants in the Fv region of the molecules. Once identified, the suitable scFVs can then be subcloned into variable heavy chain and variable light chain DNA constructs for cotransfection into COS cells for final assembly of an intact and functional immunoglobulin gamma (IgG) molecule. The IgG that is expressed by the cells can then be further characterized for specificity and reactivity as would be known in the art.

19.3.2 Monoclonal Antibody Development

Monoclonal antibodies can be developed to Zmax1 (LRP5), LRP6, HBM and HBM-like proteins/polypeptides by complete cell and adenovirus immunization of, for example, Balb/c mice (antibodies to all forms are contemplated even when only a few examples are discussed in detail). Dendritic cells can be isolated from spleens of Balb/c mice, for example, and the cells expanded in vitro in the presence of growth factors IL-4 and GM-CSF. The dendritic cells can then be infected with HBM or Zmax1 adenovirus particles. The cells are then cultured for 24 hours prior to intravenous injection into Balb/c mice. Dendritic cells ($1\times10^6$ cells/mouse) are injected 2-3 times every 3-4 weeks over a three month period.

Alternatively, purified HBM and Zmax DNAs in, for example, the pcDNA3.1 expression vector, can be coated on colloidal gold particles. These particles can then be injected subcutaneously into the desired mouse using gene gun technology. Approximately, 5 µg cDNA/mouse can be injected. Injections are performed 4-6 times every 2 weeks over approximately a 3 month period.

Another option is that cells (any species of animal, but preferably Balb/c mouse strain or the same species as the mouse strain being used which is related to limit antigen response to non-specific protein) over expressing HBM and Zmax1 (LRP5) and their respective adenovirus will be injected into the mice every 2-3 weeks for a period of about 1.5 to 3 months, as necessary. The bleeds from the mice can be tested for reactivity with the native and denatured protein by ELISA. (using purified protein or protein-fusions), cell based ELISA, inmmunohistchemical staining and Western blotting. Serum samples from the animals can be screened by FACS (fluorescent activated cell sorting) using cells infected with Zmax1 or HBM adenovirus. The spleen cells (antibody producing cells) from the mice with the strongest reactivity can then be fused with a myeloma to generate the hybridoma cells. The conditioned media from the hybridoma is then screened for the positive cell colonies for subsequent cloning. These cloned cells can then be injected into the intraperitoneal space in mice for ascites production.

19.3.3 Polyclonal Antibody Applications

Polyclonal antibodies directed against Zmax1 (LRP5) and LRP6 were developed to determine the function of these proteins, analyze the expressed pattern and levels in various tissues, cells or any biological sample. Similar antibodies could be prepared which distinguish the wild type forms from the HBM and HBM-like variants.

Uses for polyclonal antibodies against Zmax1, HBM, HBM-like polypeptides, and LRP6 include but are not limited to: analysis of bone cross-sectional mounts, tissue distribution, evaluation of expression of the protein from bone biopsy samples of affected/non-affected family members (e.g., bone cell digests, explants of bone marrow stromal cell cultures), evaluation of protein expression levels in transiently or stably transfected cells, evaluating protein concentration in tissues, serum or body fluid, purification of full length or fragments of these proteins for ligand hunting and functional assay development, identification of ligands or proteins which interact with these proteins, and elucidations of the signaling pathways of LRP6, Zmax1 (LRP5) and HBM, and related variants.

For example, Zmax1 cloned in pcDNA3.1 (Invitrogen, Carlsbad, Calif.). This was used to generate $^{35}$S-labeled in vitro translated (Promega, Madison, Wis.) Zmax1. Antibody (10 μg/ml) 3109 and 3110, which are directed against peptide immunogen, RWKASKYYLDLNSDSDPY (SEQ ID NO:711), was combined with 20 μl of the in vitro translated product in the presence of either 10 μg/ml specific peptide (i.e., RWKASKYYLDLNSDSDPY; SEQ ID NO: 711) or non-specific peptide (i.e., SGWNECASSNGHCSH; SEQ ID NO: 712) or no peptide and incubated for 1.5 hr at 4° C. Protein A Sepharose was then added to the samples (previously blocked for about 1.5 hr with reticulocyte lysate), and the samples were shaken for 1 hour at 4° C. The protein A Sepharose was washed 3 times with 0.5 ml of PBS. The bound protein was subsequently separated on a 4-12% gradient NuPAGE gel (Invitrogen) according to manrufacturer's instructions. The gel was dried at 80° C. for 30 min and then exposed to Kodak X-OMAT-AR film for 24 to 48 hr. The specific peptide was observed to significantly compete for the $^{35}$S-labeled Zmax1 immunoprecipitated protein with either antibody. The competition was not observed with a non-specific peptide.

These antibodies can also be used for immunohistochemistry. For example, HBM transgenic and wild-type mice were sacrificed using $CO_2$ narcosis. Mouse calvariae were removed intact, and the soft tissues gently dissected. The bones were fixed in 10% phosphate buffered formalin for 24 hours for further processing and analysis. After fixation, calvariae were decalcified in TBD-2 decalcifying agent (Shandon, Pittsburgh, Pa.) for about 7-8 hours and then dehydrated in graded alcohol. Calvariae were then bisected perpendicular to the sagittal suture through the central portion of the parietal bones parallel to the lambdoidal and coronal sutures and embedded in paraffin. Four to six 5 μm thick representative sections were cut.

For example, the rabbit polyclonal antibody, Zmax1/HBM (i.e., antibody 3109 and 3110) recognize Zmax1 (LRP5) in both HBM transgenic and wild-type mouse calvariae. An anti-Zmax1 or anti-HBM antibody can be used to detect Zmax1 or HBM protein in order to evaluate its abundance and pattern of protein expression. Detection can be facilitated by coupling (i.e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, P-galactosidase, or acetylcholinesterase; example of suitable prosthetic group complexes include streptavidinibiotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; and example of a luminescent material includes luminol; examples of bioluminescent materials include luciferase, luciferin and acquorien; and examples of suitable radioactive material include $^{125}$I, $^{131}$I, $^{35}$S, and $^{3}$H. Alternatively, a secondary antibody can be employed that detects the presence of the primary Zmax1 polyclonal antibody. An example would be an antibody that recognized all rabbit immnunoglobulins. This secondary antibody could be coupled in an identical manner as described above to facilitate detection. Controls comprised samples with the avidin peroxidase, but without antibody. Intensive positive staining of stroma cells and mesenchymal cells was observed in the suture area. Pre-osteoblasts and osteoblasts were observed to stain within the periosteum and some osteocytes with antibody 3109 and 3110 in the calvariae of the HBM compared to wild-type mice. High magnification of tissue calvaria sections of the HBM transgenic mice showed a pronounced cell membrane staining of the osteocytes and the cells within the suture area.

Similar antibodies could be prepared to HBM-like proteins and polypeptides, as would be readily appreciated by the artisan of ordinary skill.

20. Methods of Use: Gene Therapy

In recent years, significant technological advances have been made in the area of gene therapy for both genetic and acquired diseases (Kay et al., 1997 *Proc. Natl. Acad. Sci. USA*, 94: 12744-6). Gene therapy can be characterized as the deliberate transfer of DNA for therapeutic purposes. Improvement in gene transfer methods has allowed for development of gene therapy protocols for the treatment of diverse types of diseases. Gene therapy has also taken advantage of recent advances in the identification of new therapeutic genes, improvement in both viral and nonviral gene delivery systems, better understanding of gene regulation, and improvement in cell isolation and transplantation.

The preceding experiments identify the HBM gene as a dominant mutation conferring elevated bone mass. Additional BBM-like genes are identifiable based on the model and data presented herein regarding the propellers and structure of the HBM protein. The fact that this mutation is dominant indicates that expression of the HBM protein causes elevated bone mass. Older individuals carrying the HBM gene, and, therefore expressing the HBM protein, do not suffer from osteoporosis. These individuals are equivalent to individuals being treated with the HBM protein. These observations are a strong experimental indication that therapeutic treatment with the KBM protein prevents osteoporosis. The bone mass elevating activity of the HBM gene is termed "HBM function" or "HBM like phenotype" in the instance of other HBM variants.

Therefore, according to the present invention, a method is also provided of supplying HBM function to mesenchymal stem cells (Onyia et al., 1998 *J. Bone Miner. Res.* 13: 20-30; Ko et al., 1996 *Cancer Res.* 56: 4614-9). Supplying such a function provides protection against osteoporosis. The HBM gene or a part of the gene or other HBM-like gene may be introduced into the cell in a vector such that the gene remains extrachromosomal. In such a situation, the gene will be expressed by the cell from the extrachromosomal location.

Vectors for introduction of genes both for recombination and for extrachromosomal maintenance are known in the art, and any suitable vector may be used. Methods for introducing DNA into cells such as electroporation, calcium phosphate co-precipitation, and viral transduction are known in the art, and the choice of method is within the competence of one skilled in the art (bobbins, ed., *Gene Therapy Protocols*, Human Press, NJ (1997)). Cells transformed with the HBM gene (or HBM-like gene) can be used as model systems to study osteoporosis and drug treatments that promote bone growth.

As generally discussed above, the HBM or HBM-like gene or biologically active fragment thereof, where applicable, may be used in gene therapy methods in order to increase the amount of the expression products of such genes in mesenchymal stem cells (in all instances where discussing HBM gene and its cognate product, the HBM-like gene and cognate protein is also contemplated). It may be useful also to increase the level of expression of a given H1BM protein, or a fragment thereof, even in those cells in which the wild type gene is expressed normally. Gene therapy would be carried out according to generally accepted methods as described by, for example, Friedman, *Therapy for Genetic Diseases*, Friedman, Ed., Oxford University Press, pages 105-121 (1991).

A virus or plasmid vector containing a copy of the HBM gene linked to expression control elements and capable of replicating inside mesenchymal stem cells, is prepared. Suitable vectors are known and described, for example, in U.S. Pat. No. 5,252,479 and WO 93/07282, the disclosures of which are incorporated by reference herein in their entirety. The vector is then injected into the patient, either locally into the bone marrow or systemically (in order to reach any mesenchymal stem cells located at other sites, i.e., in the blood). If the transfected gene is not permanently incorporated into the genome of each of the targeted cells, the treatment may have to be repeated periodically.

Gene transfer systems known in the art may be useful in the practice of the gene therapy methods of the present invention. These include viral and non-viral transfer methods. A number of viruses have been used as gene transfer vectors, including polyoma, i.e., SV40 (Madzak et al., 1992 *J. Gen. Virol* 73: 1533-6), adenovirus (Berlner, 1992 *Curr. Top. Microbiol. Immunol.* 158: 39-61; Berkner et al., 1988 *BioTechniques*, 6: 616-629; Gorziglia et al., 1992 *J. Virol.* 66: 4407-12; Quantin et al., 1992 *Proc. Natl. Acad. Sci. USA* 89: 2581-2584; Rosenfeld et al., 1992 *Cell* 68: 143-155; Wilkinson et al., 1992 *Nucl. Acids Res.* 20: 2233-39; Stratford-Perricaudet et al., 1990 *Hum. Gene Ther.* 1: 241-256), vaccinia virus (Mackett et al., 1992 *Biotechnology* 24: 495-499), adeno-associated virus (Muzyczka, 1992 *Curr. Top. Microbiol. Immunol.* 158: 91-123; Ohi et al., 1990 *Gene* 89: 279-282), herpes viruses including HSV and EBV (Margolskee, 1992 *Curr. Top. Microbiol. Immunol.* 158: 67-90; Johnson et. al., 1992 *J. Virol.*, 66: 2952-65; Fink et al., 1992 *Hum. Gene Ther.* 3: 11-9; Breakfield et al., 1987 *Mol. Neurobiol.* 1: 337-371; Fresse et al., 1990 *Biochem. Phannacol.*, 40: 2189-2199), and retroviruses of avian (Brandyopadhyay et al., 1984 *Mol. Cell Biol.*, 4: 749-754; Petropouplos et al., 1992 *J. Virol.* 66: 3391-3397), murine (Miller, 1992 *Curr. Top. Microbiol. Immunol.* 158: 1-24; Miller et al., 1985 *Mol. Cell Biol.* 5: 431-437; Sorge et al., 1984 *Mol. Cell Biol.* 4: 1730-7; Mann et al., 1985 *J. Virol.* 54: 401-7), and human origin (Page et al., 1990 *J. Virol.* 64: 5370-6; Buchschalcher et al., 1992 *J. Virol.* 66: 2731-9). Most human gene therapy protocols have been based on disabled murine retroviruses.

Non-viral gene transfer methods known in the art include chemical techniques such as calcium phosphate coprecipitation (Graham et al., 1973 *Virology* 52: 456-67; Pellicer et al., 1980 *Science* 209: 1414-22), mechanical techniques, for example microinjection (Anderson et al., 1980 *Proc. Natl. Acad. Sci. USA,* 77: 5399-5403; Gordon et al., 1980 *Proc. Natl. Acad. Sci. USA,* 77: 7380-4; Brinster et al., 1981 *Cell* 27: 223-231; Constantini et al., 1981 *Nature* 294: 92-94), membrane fusion-mediated transfer via liposomes (Felgner et al., 1987 *Proc. Natl. Acad. Sci. USA* 84: 7413-7; Wang et al., 1989 *Biochemistiy* 28: 9508-14; Kaneda et al., 1989 *J. Biol. Chem.* 264: 12126-9; Stewart et al., 1992 *Hum. Gene Ther.* 3: 267-275; Nabel et al., 1990 *Science* 249: 1285-8; Lim et al., 1992 *Circulation* 83: 2007-11), and direct DNA uptake and receptor-mediated DNA transfer (Wolff et al., 1990 *Science* 247: 1465-8; Wu et al., 1991 *BioTechniques* 11: 474-85; Zenke et al., 1990 *Proc. Natl. Acad. Sci. USA* 87: 3655-9; Wu et al., 1989 *J. Biol. Chem.* 264: 16985-7; Wolff et al., 1991 *BioTechniques* 11: 474-45; Wagner et al., 1990; Wagner et al., 1991 *Proc. Natl. Acad. Sci. USA,* 88: 4255-9; Cotten et al., 1990 *Proc. Natl. Acad. Sci. USA,* 87: 4033-7; Cuniel et al., 1991 *Proc. Natl. Acad. Sci. USA,* 88: 8850-4; Curiel et al., 1991 *Hum. Gene Ther.* 3: 147-54). Viral-mediated gene transfer can be combined with direct in vivo vectors to the mesenchymal stem cells and not into the surrounding cells (Romano et al., 1998 *In Vivo,.* 12: 59-67; Gonez et al., 1998 *Hum. Mol. Genetics* 7:1913-9). Alternatively, the retroviral vector producer cell line can be injected into the bone marrow (Culver et al., 1992 *Science* 256: 1550-2). Injection of producer cells would then provide a continuous source of vector particles. This technique has been approved for use in humans with inoperable brain tumors.

In an approach which combines biological and physical gene transfer methods, plasmid DNA of any size is combined with a polylysine-conjugated antibody specific to the adenovirus hexon protein, and the resulting complex is bound to an adenovirus vector. The trimolecular complex is then used to infect cells. The adenovirus vector permits efficient binding, internalization, and degradation of the endosome before the coupled DNA is damaged.

Liposome/DNA complexes have been shown to be capable of mediating direct in vivo gene transfer. While in standard liposome preparations the gene transfer process is non-specific, localized in vivo uptake and expression have been reported in tumor deposits, for example, following direct in situ administration (Nabel, *Hum. Gene Ther.,* 3:399-410 (1992)).

21. Methods of Use: Transformed Hosts and Transgenic Animals as Research Tools and for the Development of Pharmaceuticals Cells and animals that carry the HBM, HBM-like, Zmax1 (LRP5), or LRP6 genes, used as model systems, are valuable research tools to study and test for substances that have potential as therapeutic agents (Onyia et al., 1998 *J. Bone Miner. Res.,* 13: 20-30; Broder et al., 1997 *Bone,* 21: 225-35). Discussion of one of these is meant to include the others, e.g., discussion of HBM is meant to include HBM-like variants, and so forth.

Cells for this purpose are typically cultured mesenchymal stem cells. These may be isolated from individuals with somatic or germline HBM genes. Alternatively, the cell line can be engineered to carry the HBM or HBM-like gene, as described above. After a test substance is applied to the cells, the transformed phenotype of the cell is determined. Any trait of transformed cells can be assessed, including, for example, formation of bone matrix in culture (Broder et al., 1997 *Bone,* 21: 225-235), mechanical properties (Kizer et al., 1997 *Proc. Natl. Acad. Sci. USA* 94: 1013-8), expression of marker genes and response to application of putative therapeutic agents.

Transgenic modified animals and cell lines may be used to test therapeutic agents. Transgenic modifications include, for example, insertion of the Zmax1 (LRP5) gene, LRP6, HBM gene or HBM-like gene and disrupted homologous genes. Alternatively, the inserted Zmax1, LRP6, HBM, and/or HBM-like gene of the animals may be disrupted by insertion or deletion mutation of other genetic alterations using conventional techniques, such as those described by, for example, Capecchi, 1989 *Science* 244: 1288; Valancuis et al., 1991 *Mol. Cell Biol.* 11: 1402; Hasty et al., 1991 *Nature* 350: 243; Shinkai et al., *Cell,* 68:855 (1992); Mombaerts et al., *Cell,* 68:869 (1992); Philpott et al., 1992 *Science* 256: 1448; Snouwaert et al., 1992 *Science* 257: 1 OS3; Donehower et al., 1992 *Nature* 356: 215. After test substances have been administered to the animals, the growth of bone must be assessed. If the test substance modulates (e.g., enhances) the growth of bone, then the test substance is a candidate therapeutic agent. These animal models provide an extremely important vehicle for potential therapeutic products.

The present invention also provides animals and cell lines wherein the expression of endogenous genes are activated, and may be further amplified, which does not require in vitro manipulation and transfection of exogenous DNA encoding Zmax1 (LRP5) or HBM proteins. These methods are described for example in PCT Application WO 94/12650 and U.S. Pat. No. 5,968,502, both of which are herein incorporated in their entirety by reference. In addition, the present invention includes methods wherein endogenous activation or over-expression is achieved by in situ homologous recombination, non-homologous recombination, or illegitimate recombination methods. These methods are described for example in PCT Applications WO 99/15659 and WO 00/49162, both of which are incorporated herein in their entirety.

21.1 Creating Transgenic and Gene-targeted Animals

The present invention provides genetically modified animals that recapitulate the human HBM or a HBM-like phenotype. The approaches taken involve the creation of both transgenic and gene-targeted animals that have the human G to T nucleotide substitution incorporated into the genome, express human Zmax1 (LRP5) or express a variant with a bone mass altering phenotype. These approaches can be used with any gene, such as HBM, HBM-like, LRP5 and LRP6 systems.

21.1.1 Transgenic Mice Over-Expressing the HBM Polymorphism

Plasmid constructs were prepared that utilized either the CMVbActin or type I collagen promoters to drive expression of the human HBM cDNA. The most commonly-used promoters for mammalian expression are from cytomegalovirus (CMV), Rous sarcoma virus (RSV), Simian virus 40 (SV40), and EF-1a (human elongation factor 1a-subunit). CMV is derived from the human cytomegalovirus immediate-early viral promoter. CMV is a stronger promoter in most cell lines than either RSV or SV40. The RSV promoter is derived from an avian virus and tends to be a strong promoter in avian cell lines. The SV40 promoter expresses well in cell lines that carry the large T antigen, such as COS-1. In these cell lines, the plasmid is replicated to higher copy numbers. EF-1a is beginning to be more widely used for recombinant protein expression. EF-1a is the promoter from the human elongation factor 1a-subunit, a gene that is highly expressed and conserved in mammalian cell lines.

The chimeric CMVbActin promoter is a strong promoter that has been shown to produce ubiquitous gene expression in transgenic mice including bone. This promoter was chosen to drive expression of HBM in a manner consistent with the reported widespread expression of the endogenous mouse Zmx1 (LRP5) gene. Although the HBM phenotype is observed in bone, the HBM gene may have direct or indirect effects in other tissues. Therefore, other strong ubiquitous promoters may be utilized as would be known to those skilled in the art.

Type I collagen promoters provide tissue-restricted gene expression wherein expression is primarily limited to bone. Other bone-specific promoters are available that could result in expression of HBM in bone. For example, promoters associated with proliferation of osteoblasts include histone, type I collagen, TGFβ1, MSX2, cfos/cJun and Cbfa1 may be used. Promoters associated with bone matrix maturation including alkaline phosphatase, MGP, Cbfa1, Fra/Jun and Dlx5 also can be used. Promoters associated with bone mineralization such as osteocalcin, osteopontin, bone sialoprotein and collagenase also can be used. The promoter chosen would be determined by, for example, the tissue expression, the degree of regulatable control and the like as would be known to the skilled artisan. For example, the type I collagen promoters were chosen to insure that HBM would be expressed in bone in a temporal, spatial and bone cell-specific pattern resembling the endogenous pattern of Zmax1 (LRP5) expression in bone.

21.1.2 Transgenic Mice Over-expressing the Wild-Type (LRP5) Zmax1 Gene

Plasmid constructs were prepared using the CMVbActin and type I collagen promoters driving expression of Zmax1 (LRP5). These animals can serve as a control animal model for the HBM, HBM-like and LRP6 transgenic mice (all of which are contemplated when discussing LRP5/Zmax1). Additional controls include non-transgenic littermates and wild-type animals of an identical genetic background. Methods for preparing these animals would be similar to what is discussed for mice which over express the HBM polymorphism.

21.1.3 LRP6 Gene Targeted Knock Out Mice

LRP6 knock-out mice were generated using Omnibank embryonic stem (ES) cells carrying a gene trap vector which inserted into the first intron of the LRP6 gene. The insert location was determined to be the LRP6 gene by an Omnibank Sequence Tag (OST) generated by reverse transcription PCR (RT-PCR) of a fusion transcript comprised of 5' gene trap vector sequence spliced to the host gene transcript 3' of the insertion site. The gene trap vector functionally knocks out the mouse LRP6 gene by forced spicing of LRP6 exon 1 to the IRES-LacZ-PolyA element of the gene trap, preventing transcription of LRP.

Chimeric mice were generated with ES cells, identified as OST38808, by injection into C57BL/6 albino host blastocysts which were then transferred to pseudopregnant females and allowed to develop through birth. Germ line chimeras were backcrossed to 129SvEVBrd strain mice to maintain the knockout allele of LRP6 on an inbred 1298SvEvBrd genetic background. Germ line transmission of the LRP6-KO allele was identified by PCR amplification of a gene trap specific sequence. Heterozygous LRP6-KO mating pairs were used for continued breeding. The genotype of wt and LRP6-KO progeny is determined by tail DNA PCR.

Measurements of bone density at 9 weeks of age in female heterozygous knock-out mice has shown significant ($p<0.05$) decreases in bone volume, trabecular number, and trabecular thickness as measured by uCT. These results are consistent with the hypothesis that LRP6 is also involved in modulating bone density and is a target for development of therapies and drugs. Accordingly, LRP6 transgenic animals and transgenic animals expressing bone modulating variants of LRP6 are contemplated within the scope of the invention.

21.1.4: Gene-targeted Mice Expressing the HBM Polymorphism

A gene-targeting construct was prepared that could be used to create animals containing a HBM or HBM-like knock-in (KI) allele and a Zmax1 (LRP5) knock-out (KO) allele. The gene-targeting construct contained the HBM polymorphism in exon 3 and included a neomycin selection cassette that was linked to a transcriptional stop sequence and was flanked with lox P sites. The HBM polymorphism in mouse Zmax1 results in a glycine to valine change in the amino acid sequence at position 170 of the mouse LRP5 homolog (Genbank Accession No. AF064984). Homologous recombination is used to stably introduce the construct into the mouse genome. If the transcriptional stop sequence functioned to completely block transcription of the modified Zmax1 allele, then a functional Zmax1 knock-out allele would be generated. This would facilitate production of a homozygous knock-out animal for the Zmax1 gene.

To create the knock-in allele, Cre recombinase could be used to excise the neomycin selection cassette leaving behind the modified exon 3 and one copy of the loxp site. Cre could be introduced into single-cell fertilized embryos to facilitate ubiquitous expression of HBM or by crossing animals with transgenic mice to obtain bone-specific HBM expression. Homozygous animals could be made for the HBM knock-in allele. Alternatively, animals could be created by nuclear transfer techniques, wherein nuclei from homozygous animals is transferred into a prepared oocyte (e.g., enucleated) as is known in the art. See, e.g., Campbell et al., *Nature* 380: 64-68 (1996). Additional methods of creating knock out mice include engineering a homologous recombination vector wherein the ATG start codon is deleted or mutated, engineering a frame-shift mutation into the vector, engineering deletions of critical portions of the promoter region, and/or engineering a vector to delete critical regions of the gene.

The methods used for the LRP5, LRP6 and HBM mice can similarly be used for other variants of these genes.

21.2 Materials and Methods

21.2.1 Construction of the Zmax1 (TRP5) Plasmid Zmax1GI_3AS

The full-length Zmax1 cDNA construct has been engineered into the XbaI-NotI sites of the pCMVSPORT6.0 vector from Life Technologies (part of the Gateway cloning system) to create Zmax1GI_3AS. The insert (5,278 bp) can be released from the vector by digestion with either HindIII or XbaI on the 5' side together with either EcoRV or EcoRI on the 3' end. A similar construct can be prepared for LRP6 and HBM-like nucleic acids as would be apparent to one of ordinary skill and is contemplated as well in the discussion of this section.

The Zmax1 (LRP5) construct was generated from four independent partial clones. These clones were isolated from a Zmax1 specific primed cDNA library. A partial Zmax1 cDNA clone existed in the internal survey sequencing clone set as L236B_P0049E08 isolated from an oligo-dT primed HeLa cell cDNA library. This clone was truncated at the 5-primed end. In order to isolate more 5-prime containing fragments necessary to generate a full length cDNA, a Zmax1 gene-specific cDNA library was generated from Clontech human liver poly-A MRNA (catalog #6510-1, lot# 9060032) and Life Technologies SuperScript® Plasmid System for cDNA Synthesis and Plasmid Cloning kit (catalog no. 18248-013). This library was designated as L401. The manufacturer's protocol was carried out with the following modifications. 1) In both first and second strand synthesis reactions, DEPC-treated water was substituted for $\alpha$-$^{32}$P-dCTP. 2) Reverse transcription was primed using oligonucleotides that were selected to be specific for the Zmax1 gene at approximately 1 kb intervals. These sequences were checked using the program BLAST against the public databases to ensure Zmax1 specificity. 3) Two separate reverse transcription reactions were performed. The first reaction, (A), was primed with oligdnucleotides which annealed to the more 3' regions of Zmax1 (LRP5) as follows:

```
47114:
5'-CGTACGTAAAGCGGCCGCTTGGCAATACAGA (SEQ ID NO:715)
TGTGGGA-3'

47116:
5'-CGTACGTAAAGCGGCCGCAGTAGCTCCTCTC (SEQ ID NO:716)
GGTGGC-3'

47118:
5'-CGTACGTAAAGCGGCCGCGCTCATCATGGAC (SEQ ID NO:717)
TTTCCG-3'

47120:
5'-CGTACGTAAAGCGGCCGCGCACTGCTGTTTG (SEQ ID NO:718)
ATGAGG-3'
```

The second reaction, (B), used the previously mentioned four oligonucleotides, as well as

```
47108:
5'-CGTACGTAAAGCGGCCGCGAGTGTGGAAGAA (SEQ ID NO:719)
AGGCTGC-3'

47110:
5'-CGTACGTAAAGCGGCCGCAGTAGAGCTTCCC (SEQ ID NO:720)
CTCCTGC-3'

47112:
5'-CGTACGTAAAGCGGCCGCGTCCATCACGAAG (SEQ ID NO:721)
TCCAGGT-3'
```

All oligonucleotides contained a NotI linker sequence and were used at a concentration of 0.02 ug/ul. 4) The SalI-adapted cDNA from both reverse transcription reactions was size-fractionated by electrophoresis on 1% agarose, 0.1 ug/ml ethidium bromide, 1×TAE gels. The ethidium bromide-stained cDNA between 0.6 and 8.0 kb was excised from the gel. The cDNA was purified from the agarose gel by electroelution (ISCO Little Blue Tank Electroelutor®) using the manufacturer's protocol. The purified cDNA from reactions A and B were then pooled together. 5) The size-fractionated SalI-adapted cDNA was ligated to NotI-SalI digested pBluescript® (Stratagene, La Jolla, Calif.).

Ligated library cDNA (3 ml) was used to transform electrocompetent *E. coli* cells (ElectroMAX® DH10B cells and protocol, Life. Technologies catalog no. 18290-015, BioRad *E. coli* pulser, voltage 1.8 KV, 3-5 msec pulse). The transformed cells were plated on LB-ampicillin (100 µg/ml) agar plates and incubated overnight at 37° C. Approximately 10$^6$ colony forming units (cfu) were plated at a density of 50,000 cfu/150 mm plate. Cells were washed off the plates with LB media, and collected by centrifugation. Plasmid DNA was purified from the cells using the QIAGEN Plasmid Giga Kit and protocol (catalog no. 12191) at a final concentration of 2.05 µg/µl.

Two probes for use in library screening were generated by the polymerase chain reaction (PCR) using 100 ng of library L401 as template. Standard PCR techniques were used. A reaction mixture contained 10 pmol of each oligo primer; 0.2 mM each dATP, dTTP, dCTP and dGTP (PE Applied Biosystems catalog no. NS08-0260); 1.5 units Expand™ High Fidelity Taq DNA polymerase and 1×PCR reaction buffer (Roche Molecular Biochemicals, catalog no. 732-641; 10 mM Tris-HCl, 1.5 mM MgCl$^2$, 50 mM KCl, pH 8.3). The mixture was incubated at 99° C. for one minute, followed by 30 cycles of 96° C. for 15 seconds, 50° C. for 30 seconds, 720 C for 1 minute with a final incubation at 72° C. for 7 minutes (MJResearch DNA Engine® Tetrat PTC-225). The first was generated using oligos

```
107335:  5'-CAGCGGCCTGGAGGATGC-3'     (SEQ ID NO:722)

107338:  5'-CGGTCCAGTAGAGGTTTCG-3'    (SEQ ID NO:723)
``` which amplify a NotI-SalI fragment of the Zmax1 gene. The second was generated using oligos

```
107341:  5'-CATCAGCCGCGCCTTCATG-3'    (SEQ ID NO:724)

107342:  5'-CCTGCATGTTGGTGAAGTAC-3'   (SEQ ID NO:725)
``` which amplify a SacI-KpnI fragment of the Zmax1 gene. Both PCR products were purified using the Qiaquick® kit and the manufacturer's protocol (Qiagen catalog 28106) then subdloned into the vector pCRII-TOPO® (Invitrogen catalog no. K4600) following the manufacturer's protocol. Positive subclones were identified by restriction digestion of purified plasmid DNA (using standard molecular biology techniques) and subsequent DNA sequence analysis (ABI Prism BigDye Terminator Cycle® sequencing, catalog no. 4303154, ABI 377 instruments). Probe DNA was isolated by EcoRI restriction digestion (New England Biolabs, catalog no. R0101L) of the respective sequence-verified pCRII-TOPO® clone. Restriction fragments were -size-fractionated by gel electrophoresis on 1% agarose, 0.1 ug/ml ethidium bromide, 1×TAE gels. Insert DNA was excised from the gel and purified using the Clontech NucleoSpin® Nucleic Acid Purification Kit (catalog no. K3051-2) following the manufacturer's protocol. The purified DNA fragment (25-50 ng) was labeled with Redivue® ($\alpha^{32}$P)-dCTP (Amersham Pharmacia, catalog no. AA0005) using the Prime-It II® Random Primer labeling Kit and protocol (Stratagene, catalog no. 300385). Unincorporated dCTP was removed with Amersham's NICK® column and protocol (catalog no. 17-0855-02).

Two rounds of screening library L401 were initiated to isolate fragments of the Zmax1 (LRP5) gene. In the first, forty-three 150 cm LB-100 µg/ml ampicillin agar plates were plated with primary transformants from L401 at a density of about 3,000-4,000 colonies per plate. This library was screened using the $^{32}$P-labeled probe (NotI-SalI fragment) as described above at 500,000-1,000,000 cpm/ml hybridization buffer, using standard molecular biology protocols. From this primary screen, 13 single colonies were identified based on positive hybridization to the Zmax1 probe. Plasmid DNA, prepared using the QIAprep Spin Miniprep Kit and protocol (Qiagen Inc., catalog no. 27106), was analyzed by restriction digestion and sequence analysis as described above. cDNA clone # 44 was isolated from this screen and sequence verified to contain a partial Zmax1 clone.

In the second library screen, one hundred-and-four 150 cm LB ampicillin 100 ug/ml agar plates were plated with primary transformants from L401 at a density of 3000-4000 colonies per plate. This library was screened using the $^{32}$P-labeled probe (SacI-KpnI) exactly as previously described. From this primary screen, 48 colonies were identified based on positive hybridization to the Zmax1 (LRP5) probe. Since these colonies were not single colony isolates, a secondary screen was initiated where each of the 48 primary isolates was plated at a density of approximately 500 colonies per plate. These colonies were then screened exactly as the primaries using the labeled SacI-KpnI fragment as probe. Thirty-four of the 48 primary clones resulted in positive hybridization to the Zmax1 probe and were isolated as single colonies. Plasmid DNA was prepared and analyzed as described above. cDNA isolate #71_2 was isolated from this screen and sequence verified to contain a partial Zmax1 clone.

In all cases, the sequence of any Zmax1 (LRP5) isolate was compared to a reference sequence (i.e., the sequence of the wild-type Zmax1 allele from an affected member of the HBM kindred). This analysis was important since DNA polymorphisms had been reported for this gene in the literature. This reference sequence is predicted to encode a polypeptide of Genbank Accession No. AF077820.

The four independent partial clones used to prepare ZmaxIGI_3AS are as follows:

1). Bases 1-1366: XbaI-SalI fragment was obtained from a Zmax1 cDNA construct, GTC.Zmax1_3. GTC.Zmax1_13 contains a 5075 BP insert containing the entire ORF of LRP5. The clone was blunt end cloned in the EcoRV site of pSTBlue-1. This clone was generated by fusing a 5' clone derived from screening a bone random primed cDNA library in a pBluescript™ II derivative with a 3' clone derived from a PCR product from a bone dT primed cDNA library in pBluescript™ II. PCR was performed using LRP5 specific forward primer 5'-GCCCGAAACCTCTACTGG ACCGAC-3' (SEQ ID NO: 726) and reverse primer 5'-GCCCACCCCATCA-CAGTTCA CATT-3' (SEQ ID NO: 727) using DNAzyme polymerase. The resultant 3.7 kb PCR product was cloned into PCR-XL-TOPO. To generate the full length clone the 5' and 3' plasmids were transformed into DM1 (dam-) from Gibco/BRL. The 5' plasmid was digested with XbaI and the 3' plasmid was digested with HindIII. The digested plasmids were filled in with T4 polymerase to generate blunt ends and cut with BclI the 1.7 kb 5' fragment and 3.5 kb 3' fragments were gel purified, ligated together, and cloned in the EcoRV site of pSTBlue-1. It provides a short 5'UTR, with coding sequence beginning at base 100. Furthermore, it carries some additional restriction sites at the 5' multiple cloning site. This fragment also contains a DNA polymorphism relative to the Genbank Accession No. AF077820 sequence at position 558 resulting in an A (AF077820) to a G change; this mutation does not result in an amino acid difference (Pro).

2). Bases 1367-2403: This clone was obtained from a Zmax1-gene primed cDNA library made from commercial human liver RNA described above. This fragment is a SalI-BamHI piece of DNA obtained from isolate #44. The sequence is identical to Genbank Accession No. AF077820.

3). Bases 2404-4013: This BamHI-BssHII fragment was obtained from isolate #71-2 from the same library as described above. At position 3456, there is a DNA polymorphism resulting in a G (AF077820) to an A. This nucleotide difference does not change the encoded amino acid (Val).

4). Bases 4014-5278: This BssHII-NotI fragment came from an internal clone, L236B_P0049E08. It was obtained from anoligo-dT primed HeLa cell cDNA library. The stop codon occurs at base 4947. The clone contains 331 bp of 3' UTR sequence, including a 120 bp poly-A tail followed by the NotI site. The 3' NotI site used in this subcloning step is a result of an added linker that was introduced at the end of the poly-A tail during library construction. A DNA polymorphism is present at base 4515 resulting in a G (AF077820) to C change that is silent at the amino acid level (Leu).

To generate the 5' section of the Zmax1 (LRP5) gene, the XbaI-SalI fragment and SalI-BamHI fragment were ligated into the XbaI-BamHI sites of pBluescript® (Stratagene). The 3' section of the gene was obtained by ligating the 1.61 kb BamHI-BssHII fragment from Zmax1 isolate #71_2 to the 1.26 kb BssHII-NotI fragment from L236B_P0049E08. These two fragments were ligated into the BamHI-NotI sites of pBluescript®. The full length Zmax1 cDNA was engineered into the XbaI-NotI sites of the vector pCM-VSPORT6.0 (Life Technologies) by ligation of the XbaI-BamHI 5' section and the BamHI-NotI 3' section. The resulting plasmid, ZmaxGI_3AS, contains an insert of 5278 bp from the XbaI site to the NotI site of the vector's multiple cloning site. This clone is in the antisense orientation with respect to the CMV promoter present in the vector. Zmax1 coding sequence begins at base 100 and ends at base 4947, followed by 331 bp of 3-primed UTR sequence including a 120 bp poly-A tail. This full length cDNA contains three DNA polymorphisms from the reference sequence (GenBank Accession No. AF077820) that do not alter the predicted amino acid sequence. These polymorphisms are at position 558 resulting in an A to G that maintains the proline residue; at position 3456 resulting in a G to A that maintains the valine residue; and, at position 4515 resulting in a G to C that maintains the leucine residue.

The sequence of Zmax1 GI_3AS (FIG. 25) also contains a DNA polymorphism relative to SEQ ID NO. 1 at base, 4088 resulting in a C (SEQ ID NO: 1 and Genbank Accession No: AB017498) to T change that results in an amino acid change at position 1330 of alanine to valine. This is consistent with the sequence determined in the wild-type allele from an affected member of the HBM kindred as well as with the published sequence of GenBank Accession No. AF077820. Zmax1GI_3AS also has 29 additional bases at the 5' end relative to SEQ ID NO: 1, as well as 129 bases at the 3' end consisting of an extra G, 120 bases of poly-A tract, and the NotI site.

21.2.2 Creation of the HBM Mutation G171V

The HBM mutation that results in a predicted amino acid change from glycine to valine at amino acid 171 was introduced into the full length human Zmax1 (LRP5) cDNA (plasmid Zmax1GI_3AS) using PCR to change the G at position 611 to a T. Introduction of the HBM mutation was done using oligos 107335: (5'-CAGCGGCCTGGA GGATGC-3'; SEQ ID NO: 728) and 49513: (5'-CGGGTACATGTACTGGA-CAGC TGATTAGC-3'; SEQ ID NO: 729), which flank the endogenous NotI site of the Zmax1 (LRP5) gene. This method creates a new PvuII site at the 3' end of the PCR product. A second PCR reaction was completed using oligos which introduce a ScaI site at the 5' end of the product and contains the endogenous SalI site of Zmax1 in the 3-primed end. PCR products were purified using the QiaQuick® procedure (Qiagen Inc.); subcloned into the vector pCRII-TOPO (Invitrogen) as described above. Plasmid DNA was purified from single bacterial colonies and analyzed by restriction digest and subsequent sequence analysis, all as described above. The sequence-verified pCRII-TOPO clones were restriction digested with NotI-PvuII and ScaI-SalI, respectively. The resulting DNA fragments were size fractionated and purified as described above. These two fragments were then subcloned into the vector, pBluescript® that had been prepared by NotI-SalI digestion. Both PvuII and ScaI produce blunt ends when used to digest double stranded nucleic acids. Thus, the resulting ligated fragment fails to recreate either the PvuII or ScaI site and contains only the consensus Zmax1 sequence, with the exception of the newly introduced HBM mutation. To introduce the mutation into the full length Zmax1 gene, this resulting plasmid was digested with MscI and SalI, while the 5' region of Zmax1 was obtained by XbaI-MscI digestion of Zmax1 plasmid GTC.Zmax1_13. These two fragments were ligated together into XbaI-SalI digested pBluescript®, in effect creating a similar 1.366 klb XbaI-SalI fragment. The only difference being that this construct contains the HBM mutation described above. The full length HBM cDNA then was assembled into pCM-VSPORT6.0 exactly as described above for the Zmax1 gene, with the substitution of this newly created XbaI-SalI fragment containing the HBM mutation. The entire cDNA insert was verified by DNA sequence analysis and the introduction of the HBM mutation was confirmed.

The resulting plasmid, HBMGI_2AS (FIG. 24), contains an insert of 5,278 bp from the XbaI site to the NotI site of the vector's multiple cloning site. This clone is in the antisense orientation with respect to the CMV promoter in the vector. HBM coding sequence begins at base 100 and ends at base 4947, followed by 331 bp of 3-primed UTR sequence which includes a 120 bp poly-A tail. This full length cDNA contains three DNA polymorphisms from the reference sequence, which do not alter the amino acid sequence. These polymorphisms occur at position 558, resulting in an A to G change that maintains the proline residue; at position 3456 resulting in a G to A change that maintains the valine residue; and, at position 4515 resulting in a G to C change that maintains the leucine residue. Additionally, the HBM mutation is present at position 611 (G in Zmax1 to T in HBM) which results in a predicted amino acid change of glycine to valine at amino acid position 171, as found in affected members of the HBM kindred. This insert sequence was used to generate the construct used for IBM over-expressing transgenic mice.

21.3 Transgene Preparation

The examples provided herein are illustrations of how transgenic animals can be prepared. Additional transgenic animals can be prepared as would be known in the art. See, for example, Glenn Monastersley et al., ed, *Strategies in Transgenic Animal Studies* (Amer. Soc. Microbiology 1995),and the references cited therein.

21.3.1 CMVbActin Promoter-HBM cDNA (HBM-MCIBA)

To prepare the CMVbactin-HBM construct, pCX-EGFP, a plasmid containing the chimeric CMVbactin promoter, was purified as a 4778 bp EcoRI fragment. Subsequently, the HBM cDNA was excised from HBMGI_2AS as a 4994 bp XbaI/DraI fragment, treated with Klenow fragment of DNA polymerase, ligated to EcoRI linkers, and digested with EcoRI. This fragment was then inserted into the EcoRI site of pCX-EGFP. A SpeI/HindIII 7265 bp CMVbactin-HBM fragment was purified for microinjection into mouse embryos.

21.3.2 Type T Collagen Promoter-HBM cDNA (HBM-MTTC)

The rat type I collagen promoter-HBM construct was created by first replacing the pBS(SK-) (Stratagene) polylinker with another polylinker (i.e., comprising KpnI-SpeI-HindIII-BglII-NdeI-SalI-SmaI-EcoRI-PstI-BamHI-XbaI-ScaI-NcoI- ClaI-NotI-SacII-SacI), that is referred to as BS(SK-)A/D. The SV40 splice and poly (A)$_n$ XbaI-NcoI region (750 bp) from pcDNA I (Invitrogen, Inc.) was directionally cloned into BS(SK-)A/D. Next, a 4994 bp EcoRI HBM cDNA fragment (above) was cloned into the EcoRI site. A 3640 bp XbaI, type I collagen promoter fragment was subcloned into the XbaI site of BS(SK-) (Stratagene). The promoter fragment was then excised from BS(SK-) with SacII, blunt-ended with T4 DNA polymerase, digested with SpeI, and ligated into the HBM BS(SK-) A/D construct, which was digested with NdeI, blunted with T4 DNA polymerase, and digested with SpeI. A SpeI/ClaI 9435 bp type I collagen-HBM fragment was purified for microinjection into mouse embryos.

21.3.3 CMVbActin Promoter-Zmax1 cDNA (Zmax1WTCBA)

The CMVbActin promoter-HBM cDNA construct from above was used to generate the final plasmid. The following three fragments were ligated together: 1) a 6.34 kb XbaI-KpnI backbone fragment from HBNMCBA; 2) a 0.64 kb XbaI-SapI fragment from HBMMCBA containing the 3' end of the bActin promoter and the 5' end of the HBM cDNA; and 3) a 2.8 kb SapI-KpnI fragment derived from the Zmax1 cDNA that contains the wild-type sequence. A 7.2 kb SpeI-HindIII CMVbActin-Zmax1 fragment was purified for micro-injection into mouse embryos.

21.3.4 Type T Collagen Promoter-Zmax1 cDNA (Zmax1WTTIC)

The type I collagen-HBM cDNA construct from above was used to generate the final plasmid. The HBMMTIC plasmid was linearized with HindIII and cut with either SalI to yield a 8.52 kb HindIII-SalI fragment or SapI to yield a 2.98 kb SapI-HindIII fragment. A 2.8 kb SapI-SalI fragment from the Zmax1 (LRP5) cDNA containing the wild-type sequence was then ligated to the above two fragments to yield the final plasmid. A 9.4 kb SpeI-ClaI type I collagen-Zmax1 fragment was purified for micro-injection into mouse embryos.

21.4 Confirmation of Transgene Expression in vitro

Plasmid constructs for HBMMCBA, BBMMTIC, Zmax1 WTCBA and Zmax1WTTIC were transiently transfected into human osteoblast (I40B) cells to measure MRNA expression as a test for functionality.

21.4.1 Transient Transfections

HOB-02-02 cells are a clonal, post-senescent, cell line derived from the HOB-02-C1 cells (Bodine et. al, 1996, *J. Bone Miner. Res.* 11: 806-819). Like the parental cell line, the HOB-02-02 cells express the temperature-sensitive SV40 large T-antigen mutant, tsA209. Consequently, these cells proliferate at the permissive temperature of 34° C., but stop dividing at non-permissive temperatures of 37° C. or above. Also like the parental cell line, the HOB-02-02 cells are cultured with Growth Medium (D-MEM/F-12 containing 10% heat inactivated fetal bovine serum, 1% penicillin-streptomycin and 2 mM GlutaMAX-1) at 34° C. in a 5% $CO_2$/95% humidified air incubator (Forna Scientific, Marietta, Ohio).

For the transient transfections, the HOB-02-02 cells were seeded with Growth Medium at 400,000 cells/well into 6-well plates and incubated overnight at 34° C. The cells Were transfected with 0.3 mg/well of either the CMVβActin-HBM expression plasmid, the Type I Collagen-HBM expression plasmid or the corresponding empty vectors using LipofectAMINE 2000 transfection reagent according to the manufacturer's instructions (Life Technologies, Rockville, Md.). After a 24 hr incubation at 34° C., the medium was changed, and the cells were incubated for an additional 24 hr at 39° C. At the end of this last incubation, the cells were rinsed with Hank's buffered salt solution. Total cellular RNA was then isolated using TRIzol® according to the manufacturer's instructions (GibcoBRL, Grand Island, N.Y.). The RNA was treated with RNase-free DNase in order to remove contaminating DNA as previously described (Bodine et al., 1997, *J. Cell. Biochem.* 65: 368-387).

21.4.2 TaqMan® Assay for mRNA Expression

TaqMan® primers and probes were chosen based on human and mouse Zmax1 (LRP5) cDNA sequences. The selected sequences were designed to be gene-specific by analysis of an alignment of human and mouse Zmax1 (LRP5) sequences as illustrated in FIG. 26.

TaqMan® quantitative reverse transcriptase-polymerase chain reaction (RT-PCR) analysis of RNA isolated from human cells was performed as described by the manufacturer (PE Applied Biosystems, Foster City, Calif.) using the following primers and probe set:

```
Human Zmax1-1/HBM-1:

Forward Primer:
5'-GTCAGCCTGGAGGAGTTCTCA-3'        (SEQ ID NO:730)

Reverse Primer:
5'-TCACCCTTGGCAATACAGATGT-3'       (SEQ ID NO:731)

Probe:
6-FAM-5'-CCCACCCATGTGCCCGTGACA-3'  (SEQ ID NO:732)
```

Results from the experimental primers/probe set were normalized to human GAPDH levels using the multiplex protocol with the human GAPDH control kit from PE Applied Biosystems. Species-specific TaqMan® quantitative RT-PCR analysis of RNA isolated from murine cells and tissues was performed as described by the manufacturer (PE Applied Biosystems, Foster City, Calif.) using the following primers and probes sets:

```
Human Zmax-1/HBM-1:

Forward Primer:
5'-CGTGATTGCCGACGATCTC-3'          (SEQ ID NO:733)

Reverse Primer:
5'-TTCCGGCCGCTAGTCTTGT-3'          (SEQ ID NO:734)

Probe:
6-FAM-5'-CGCACCCGTTCGGTCTGACGC     (SEQ ID NO:735)
AGTAC-3'

Mouse Zmax-1/HBM-1:

Forward Primer:
5'-CTTTCCCCACGAGTATGTTGGT-3'       (SEQ ID NO:736)

Reverse Primer:
5'-AAGGGACCGTGCTGTGAGC-3'          (SEQ ID NO:737)

Probe:
6-FAM-5'-AGCCCCTCATGTGCCTCTCAA     (SEQ ID NO:738)
CTTCATAG-3'
```

Results from the experimental primers/probe sets were normalized to 18S ribosomal RNA levels using the multiplex protocol with the 18S ribosomal RNA control kit from PE Applied Biosystems. A summary of these results is presented in FIGS. 17-20.

21.5 Production of Transgenic Mice 21.5.1 DNA Microinjection:

Transgene fragments for micro-injection were first purified on 1% agarose gels according to the GELase protocol from Epicentre Technologies. Fragments were then further purified on cesium chloride density gradients and extensively dialyzed against 5 mM Tris (pH 7.4), and 0.1 mM EDTA.

Linearized DNA was microinjected into mouse embryos according to standard procedures. DNA was injected into primarily the male pronucleus of fertilized C57BL/6T mouse embryos. Injected embryos (n=20-35) were transferred to the oviduct (unilaterally) of day 0.5 post coitum pseudopregnant Swiss Webster embryo recipients. Offspring were tail-biopsied and genotyped at age 10-14 days.

Figure 16:
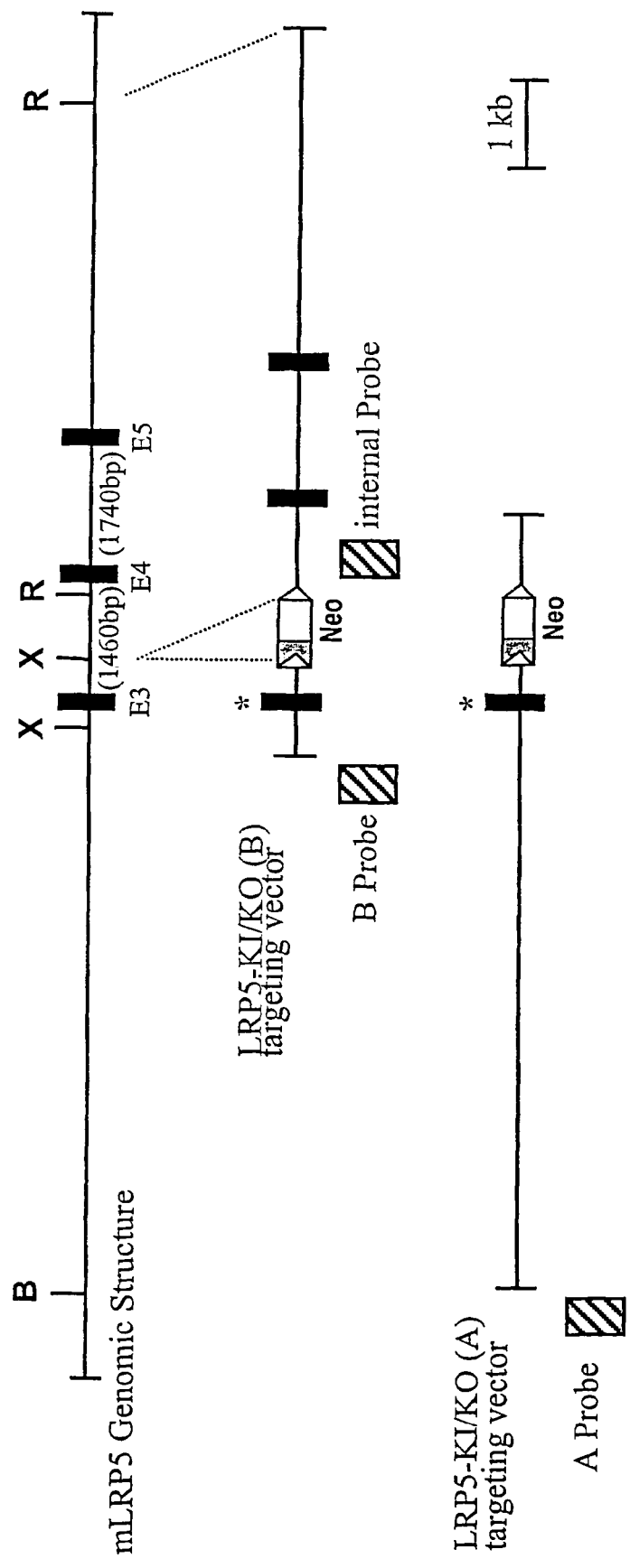
FIG. 16 depicts a schematic of two Zmax1 (LRP5) gene targeting vectors for the knock-out of endogenous mouse Zmax or conditional knock-in of the HBM polymorphism. B, X, and R indicate BamHI, XbaI, and EcoRI sites in DNA BAC 4735P5 respectively. Exons 3, 4, and 5 are indicated by black rectangles. A G→T base change is engineered at base 24 of exon 3 to produce the HBM polymorphism. The location of a LoxP flanked cassette containing a neomycin resistance gene and a synthetic pause sequence and probes used for screening and characterizing of ES cell clones are also indicated.
Figure 18:
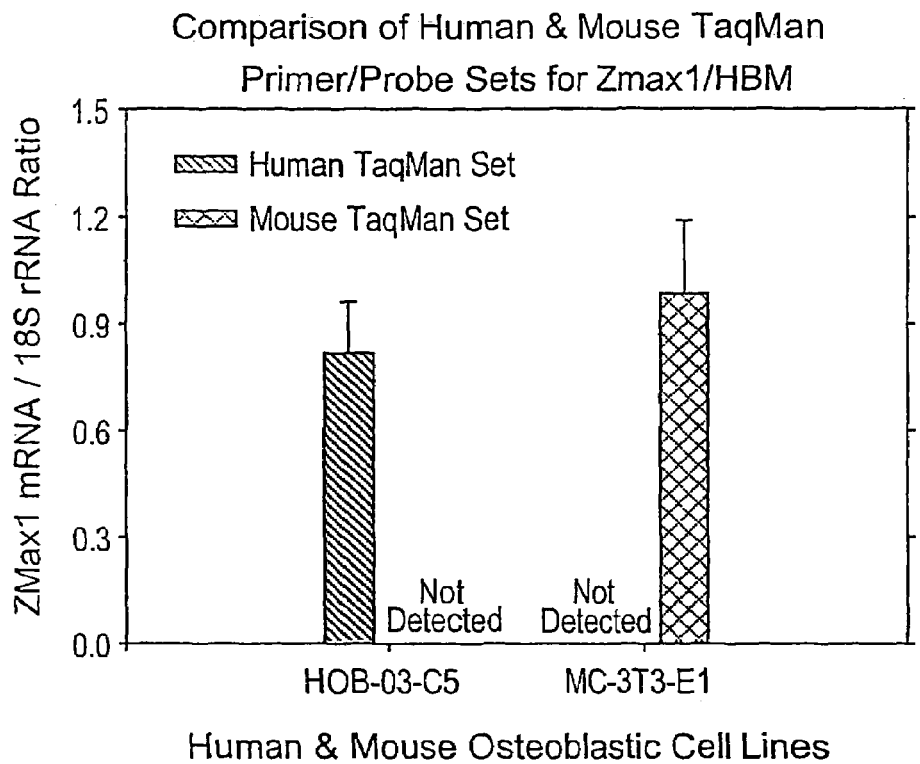
FIG. 18 depicts a comparison between the human and mouse TaqMan® Primer/Probe sets. HOB (HOB-03-C5) and mouse (MC-3T3-E1) osteoblastic cell mRNA was analyzed using the probes and primers.
Figure 19:
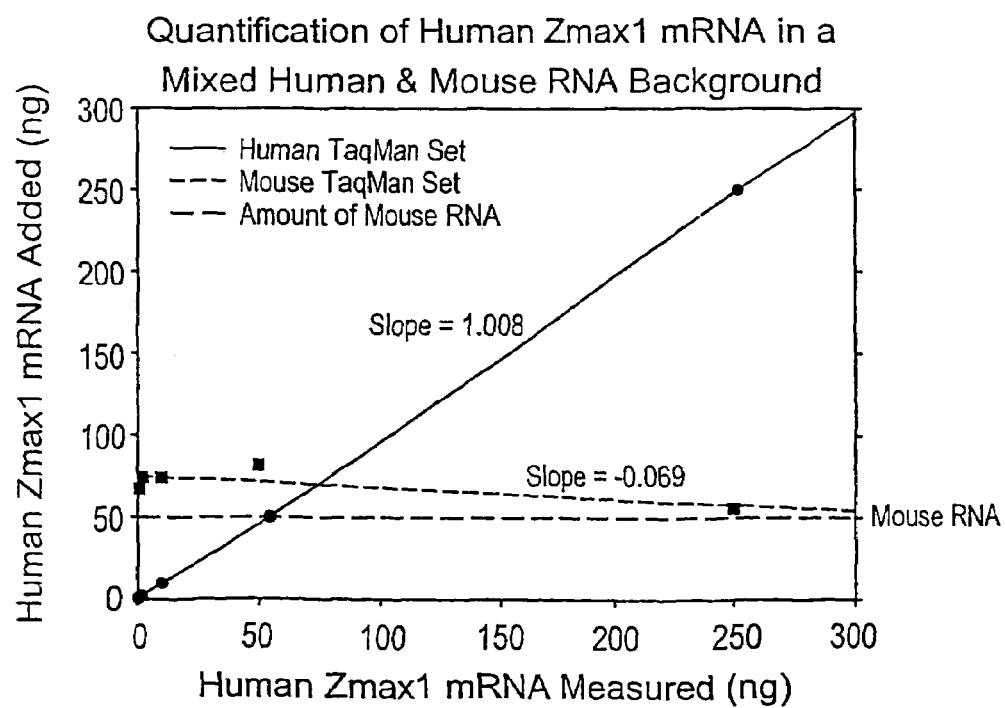
FIG. 19 depicts the quantification of human Zmax1 (LRP5) mRNA expressed in a mixed human and mouse RNA background using the TaqMan® Primer/Probe sets. Results are presented in Human Zmax1 (LRP5) mRNA added (ng) versus Human Zmax1 (LRP5) mRNA measured (ng).

21.6 Production of Gene-targeted Transgenic Mice 21.6.1 Gene Targeting Vectors and Probes Two gene-targeting vectors were constructed for modification of the Zmax1 (LRP5) gene in embryonic stem (ES) cells. The two constructs, illustrated in FIG. 16, designated as Zmax1 -KI/KO A&B were designed to generate two types of mutations, a knock-out (KO) of the Zmax1 gene and a Cre recombinase dependent knock-in (KI) of a nucleotide substitution in order to create a mouse model (i.e., glycine 170 to valine amino acid substitution in mouse Zmax1, of the HBM kindred.

Both gene-targeting vectors were constructed using genomic DNA of the mouse genomic DNA BAC clone 473P5 (Genbank Accession No. AZ095413) containing the first five exons of the mouse Zmax1 gene. This clone was isolated by Research Genetics (Huntsville Ala.) from their mouse 129SvJ genomic BAC library using a polymerase chain reaction (PCR) screen for exon 3. A forward and reverse primers of

```
Forward:
5'-GAGCGGGCAGGGATGGATGG-3'      (SEQ ID NO:739)

Reverse:
5'-AGGTTGGCACGGTGGATGAAGC-3'    (SEQ ID NO:740)
``` were used to amplify exon 3 by PCR; the following thermal cycling conditions were employed: for thirty cycles, 95° C. for 0.5 minute, 55° C. for 1 minute and 72° C. for 1 minute. Identity of this clone with mouse Zmax1 was confirmed by sequencing exon 3 using the BAC clone DNA as template. PCR products were cloned using the pGEM-T-easy T/A cloning kit.

21.6.2 Zmax1 (LRP5) Knock-in/Knock-out Vector

The organization of the genomic BAC clone 473P5 was characterized by Southern blot analysis using subcloned exon 1, exon 2 and exon 3 as probes and by sequencing the region spanning exon 1 through exon 5. Two different constructs were prepared for the Zmax1 KI/KO targeting. These constructs (A and B) differ only in flanking arms of homology. Construct (A) contains a 6.5 kb BstEII-XbaI 5' arm of homology and a 1 kb XbaI-EcoRI 3' ann of homology; whereas, construct (B) contains a 1 kb 5' arm of homology and a 6.0 kb 3' arm of homology. The constructs were prepared by ligating short and long arms of homology to a LoxP flanked cassette containing the neomycin resistance gene MC1-Neo, Stratagene) and a synthetic transcriptional pause sequence (Promega).

Both Zmax1-KI/KO-targeting vectors (A and B) were modified to a G-to-T nucleotide substitution, encoding the G170V amino acid substitution, in exon 3. These modifications were introduced into by overlapping PCR mutagenesis using the wild type sequence of the short arm of homology as template. In addition, the 1 kb short arm of the Zmax1-KI/KO (B) targeting vector was modified to include a 5' terminal PmeI restriction recognition site. The 5' overlapping fragment was made using the following forward primer and reverse mutagenic primer:

```
Forward:
5'-AAGCTTGTTTAAACTGGGCATGGTGGCACA    (SEQ ID NO:741)
TGGTTGTAAT-3'

Reverse:
5'-GGGCTTCCACCCAGTCAGTCCAGTACATGT    (SEQ ID NO:742)
ACCT-3'.
```

The thermal cycling conditions utilized for thirty cycles are 95° C. for 0.5 minute, 55° C. for 1 minute and 72° C. for 1 minute. The 3' fragment was made using the following forward and reverse primers:

```
Forward:
5'-CTGACTGGGTGGAAGCACCCCGGATCG       (SEQ ID NO:743)
AGC-3'

Reverse (mutagenic):
5'-GAATTCATCGGTACCTGTGCGGCCGCT       (SEQ ID NO:744)
TCATTG-3'.
```

The thermal cycling conditions utilized for thirty cycles are 95° C. for 0.5 minute, 55° C. for 1 minute and 72° C. for 1 minute. The final overlapping PCR used 1 ml each of the 5' fragment and 3' fragment PCR reactions as template and amplification was performed using the forward and reverse primers of the 5' and 3' fragments respectively and the same thermal cycling parameters. The final PCR product was cloned using the pGEM-T-easy T/A cloning kit. The mutagenized exon 3 was excised from Zmax1-KI/KO (1) and transferred to Zmax1-KI/KO (A) as a 600 bp BsmBI-XbaI fragment.

Probes for screening for and characterization of Zmax1-KI/KO (A) gene targeted ES cell clones are prepared by subcloning restriction fragments of BAC clone 473P5. The 5' outside probe is a 400 bp Nde-BstEII fragment, and the 3' outside probe is a 500 bp EcoRI-BstXI fragment.

The outside probes for Zmax1-KI/KO (B) are prepared by PCR cloning genomic fragments flanking and immediately adjacent to the targeting vector region of homology. The 5' outside probe used for Zmax1KI/KO (B) is a 498 bp fragment generated using the forward primer of the sequence (5'-TGAGATGTCCTGTCTGTGGC-3'; SEQ ID NO: 745) and a reverse primer of the sequence (5'-TCCTTCCTTCCCTA-CAGTTG-3'; SEQ ID NO: 746). The thermal cycling conditions utilized with these probes for thirty cycles are: 95° C. for 0.5 minute, 55° C. for 1 minute and 72° C. for 1 minute. The 3' outside probe is a 600 bp fragment generated using the forward primer of the sequence (5'-CCTAAGGATCTCCT-TGT GTCTGTGG-3'; SEQ ID NO: 747) and a reverse primer of the sequence (5'-CTGCAGCAG GTCAGTAGCCTGC-3'; SEQ ID NO: 748). The thermal cycling conditions utilized with these probes for thirty cycles were: 95° C. for 0.5 minute, 55° C. for 1 minute and 72° C. for 1 minute. Both probes are specific for the Zmax1 gene in genomic southern analysis. PCR products are cloned using the pGEM-T-easy T/A cloning kit.

A probe for ribonuclease protection analysis of Zmax1 mRNA structure and 15 transcription levels was prepared by PCR cloning a cDNA fragment containing exon 3 through exon 4. The PCR reaction used a complete cDNA as template, a forward primer of the sequence (5'-TGAGATGTCCT-GTCTGTGGC-3'; SEQ ID NO: 749), a reverse primer of the sequence (5'-TCCTTCCTTCCCTACAGTTG-3'; SEQ ID NO: 750) and the following thermal cycling conditions for thirty cycles; 95° C. for 0.5 minute, 55° C. for 1 minute and 72° C. for 1 minute. The PCR product is cloned using the pGEM-T-easy T/A cloning kit.

One skilled in the art could use similar protocols to generate other engineered KI-alleles to produce transgenic animals with an HBM-like phenotype.

21.6.3 Gene Targeting in ES Cells

For gene targeting, embryonic stem (ES) cells are electroporated with 50 mg of linearized targeting vector and selected in 200 mg/ml G418 for 7-10 days beginning the day after electroporation. G418 resistant clones are picked, expanded and cryopreserved. Resistant clones were screened for homologous recombination by an EcoRI genomic Southern restriction fragment length analysis using the 5' outside probe, which detects the wild type and targeted alleles of Zmax1 as 4 kb and 5 kb fragments, respectively. Gene targeted ES cell clones are thawed, expanded, and characterized by ScaI genomic restriction fragment length analysis using the 3' outside probe, which detects the wild type and targeted alleles of Zmax1 as 9 kb and 8 kb fragments, respectively. Gene targeted clones are also characterized by sequence analysis of Zmax1 exon 3 to ensure that the G to T substitution was included in homologous recombination.

21.6.4 Production of Gene Targeted Mice by Blastocyst Injection

To generate chimeric mice, gene targeted ES cell clones are thawed, expanded and 9-14 ES cells injected into the blastocoel of 3.5 post coitum (p.c.) host C57BL/6 blastocysts. Injected blastocysts (12-17) are then transferred unilaterally into the uterus of 2.5 p.c. pseudopregnant Swiss Webster embryo recipients and allowed to develop to term. Chimeric males are back-crossed to 129SvEv females and tested for transmission of the targeted allele by PCR geneotyping with primers specific to the neomycin resistance gene.

21.6.5 In vitro Deletion of the Neomycin Resistance Cassette via Cre Recombinase To generate Zmax1 (LRP5) KI mice from the Zmax1 KI/KO mice the Neomycin resistance (KO) cassette was deleted by micro injection of a Cre expressing plasmid (2 mg/ml) into the male pronucleus of Zmax1 KI/KO pre-fusion zygotes. Deletion of the KO cassette was confined by PCR analysis of the cassette insertion site.

21.6.6 Gentling Transgenic Mice

Genomic DNA was isolated from mouse tail snips by digestion in 500 ul buffer containing 50 mM Tris-HCl, (pH 7.2), 50 mM EDTA, (pH 8.0), 0.5% SDS and 0.8 mg/ml proteinase K. Samples are incubated at 55° C. with shaking overnight. A 10 μl aliquot was heat-inactivated at 99° C. for 5 minutes and diluted 1:20 in water. For PCR, 1 μl of the diluted DNA was amplified under the following conditions: Denature: 96° C. for 4.5 min; 45 cycles: 96° C. for 30 sec; 63° C. for 1 min; 72° C. for 1 min; Extension: 72° C. for 5 min; 4° C. hold.

The following primer sets are used for genotyping:

```
HBMMCBA:
5'primers 296 bp fragment
(SEQ ID NOS:751-752 respectively)

Forward:   5'-GCT TCT GGC GTG TGA CCG GCG-3'

Reverse:   5'-GCC GCACAG CGC CAG CAG CAG C-3'

3'primers: 400 bp fragment
(SEQ ID NOS:753-754 respectively)

Forward:   5'-CAC CCA CGC CCC ACA GCC AGT A-3'
```

```
                       -continued
Reverse:   5'-ATT TGC CCT CCC ATA TGT CCT TCC-3'

HBMMTIC:
5'primers: 382 bp fragment
(SEQ ID NOS:755-756 respectively)

Forward:   5'-TTC CTC CCA GCC CTC CTC CAT CAG-3'

Reverse:   5'-GCC GCA CAG CGC CAG CAG CAG C-3'

3'primers: 524 bp fragment
(SEQ ID NOS:757-758 respectively)

Forward:   5'-GAA TGG CGC CCC CGA CGA C-3'

Reverse:   5'-GCT CCC ATT CAT CAG TTC CAT AGG-3'
```

21.6.7 Confirmation of Genotype by Southern Analysis

Mouse genomic DNA was digested with EcoRI and probed with a 1.0 kb SalI-BamHI restriction fragment from the Zmax1 cDNA. The probe hybridizes to a 5 kb fragment in transgene positive animals.

21.7 Phenotyping

Both in vivo and ex vivo assays are used to evaluate the phenotype in transgenic mice. Two strains of wild-type mice, namely C57BL/6 and 129 SvEv, are studied to provide control data for phenotypic evaluation in transgenic and gene-targeted mice. In addition, non-transgenic littermate animals are used as controls.

21.7.1 In vivo Analysis

Spinal bone mineral content (BMC) and bone mineral density (BMD) measurements performed at Creighton University (Omaha, Nebr.) were made by DXA using a Norland Instruments densitometer (Norland XR2600 Densitometer, Dual Energy X-ray Absorptiometry, DXA). Spinal BMC and BMD at other locations used the machinery available. There are estimated to be 800 DXA machines currently operating in the U.S. Most larger cities have offices or imaging centers which have DXA capabilities, usually a Lunar or Hologic machine. Each location that provided spine BMC and BMD data included copies of the printouts from their machines to provide verification that the regions of interest for measurement of BMD have been chosen appropriately. Complete clinical histories and skeletal radiographs were obtained.

The HBM phenotype (and HBM like phenotype which is also included when discussing the EBM phenotype) in human and animal subjects, preferably humans, can be described using criteria such as: very high spinal BMD; a clinical history devoid of any known high bone mass syndrome; and skeletal radiographs showing a normal shape of the appendicular skeleton.

pDXA: Wild-type and transgenic mice are anesthetized, weighed and whole-body X-ray scans of the skeleton generated using the LUNAR small animal PIXImus device. Scans are begun when the mice are weaned (i.e., at 3 weeks of age) and repeated at 2 week intervals. Wild-type animals are scanned at 3, 5, 7, 9, 11, 13, 15, 17, 19, 21, 23, 27, and 29 weeks. Scanning of transgenic animals would be performed for periods up to 17 weeks. Scans are analysed for BMD (bone mineral density), BMC (bone mineral content), TTM (total tissue mass), and % fat for various body regions.

Faxitron radiographs: Following pDXA scanning of anesthetized animals, an additional X-ray was taken using a Faxitron device allowing measurement of bone size.

Calcein labeling: Animals are dosed with 15 mg/kg calcein intraperitoneally on two consecutive occasions. The first dose was given 9 days before euthanasia and the second given 2 days before euthanasia allowing measurement of bone formation rate.

21.7.2 Ex vivo Analysis

RNA isolation Total RNA was isolated from tibia and other tissues using TRIzol® to determine mRNA expression.

pQCT: The right femur was cleaned of soft tissue and stored in 70% ethanol for determination of total and trabecular density of the distal metaphysis and cortical density of the mid-shaft.

MicioCT: The right femur was used to determine trabecular indices of the distal metaphysis.

Histology: The right femur was used to determine bone area and static and dynamic parameters of the distal metaphysis.

Bending strength: The left femur was cleaned of soft tissue and stored at −20° C. prior to analysis of 3-point bending strength of the mid-shaft.

Compressive strength of vertebra: The entire spine was removed from T10-L6-7. Soft tissue was left on and the spine frozen at −20° C. until analysis. Compressive strength was measured at the L5 vertebra.

Serum: Animals are euthanized and serum prepared from blood to measure total cholesterol, triglycerides, osteocalcin and other biochemical markers.

Lysis: Examples include immunocytochemistry, such as in situ hybridization of osteogenic markers and TUNNEL staining of cells undergoing apoptosis.

21.8 Results 21.8.1. Confirmation of Expression from Transgenic Plasmid Constructs The HBM (HBMMCBA and HBMMTIC) and wild-type (Zmax1 WTCBA and Zmax1 WTTIC) plasmid constructs were transiently transfected into HOB-02-02 cells, which have a very low endogenous level of Zmax1 (LRP5) expression. Two days after transfection, RNA was isolated and TaqMan® quantitative RT-PCR was performed to determine the mRNA levels of Zmax1/HBM in the cells. To control for contaminating plasmid DNA, PCR was performed with or without the prior RT step, in the absence of the RT step, only very low levels of Zmax1/HBM MRNA were detected. However, with the RT step, a 1000-fold increase in HBM and Zmax1 mRNA was observed in cells transfected with CMV-bActin-promoter constructs as compared to those' transfected with the CMV-b-Galactosidase control. The type I collagen promoter constructs showed approximately 10-fold increases in HBM and Zmax1 mRNAs, which is consistent with the weaker nature of this promoter compared to the CMVβActin promoter. See FIG. 17.

21.8.2 Species Specific TaqMan® Reagents for HBM/Zmax1 Expression

Species specific TaqMan® primer and probe sets for Zmax1/HBM were developed. In a series of experiments using HOB cells and mouse MC-3T3-E1 osteoblastic cells, Zmax1/HBM mRNA was measured in a mouse background, and vise versa. These reagents useful for the detection and quantization of species-specific expression. As demonstrated in FIG. 18, the primer sets are species specific in the mouse and human cell lines. Further, FIG. 19 demonstrates the quantitative measurement of human Zmax1 RNA in a background of mouse RNA. These TaqMan® sets can be used to determine the levels of human or mouse HBM or Zmax1 (or other HBM-like variant) message that are being expressed in the mouse transgenic lines.

The species-specific TaqMan® reagents are novel tools for the characterization of both is endogenous Zmax1 mRNA levels and human Zmax1/HBM mRNA levels in the transgenic mouse tissues. These tools have several advantages over other conventional methods, such as Northern hybridization and standard RT-PCR. Some of these advantages are as follows: (1) specificity, since only a small region (<100 bps) is amplified primers and probes are chosen to sequence regions predicted to have no or minimal cross-reactivity; (2) speed, since the procedure is less labor intensive; (3) accuracy, since it is truly quantitative; and (4) sensitivity, since it requires only small amounts of starting material (i.e., RNA) and the signal-to-noise ratio is high. These advantages are especially important for analyzing mRNA levels in bone, because it is difficult to obtain large amounts of RNA from bone. Thus, the primer sets developed for TaqMan® analysis of a HBM and Zmax I expression are important embodiments of the present invention. One skilled in the art will recognize that the primers described here are preferred embodiments; modifications such as extension or truncation of a primer or base substitution are encompassed by the present invention so long as the resultant nucleic acid continues to perform substantially the same function.

21.8.3 HBM Expression in Transgenic Mice

Figures 20, 21A:
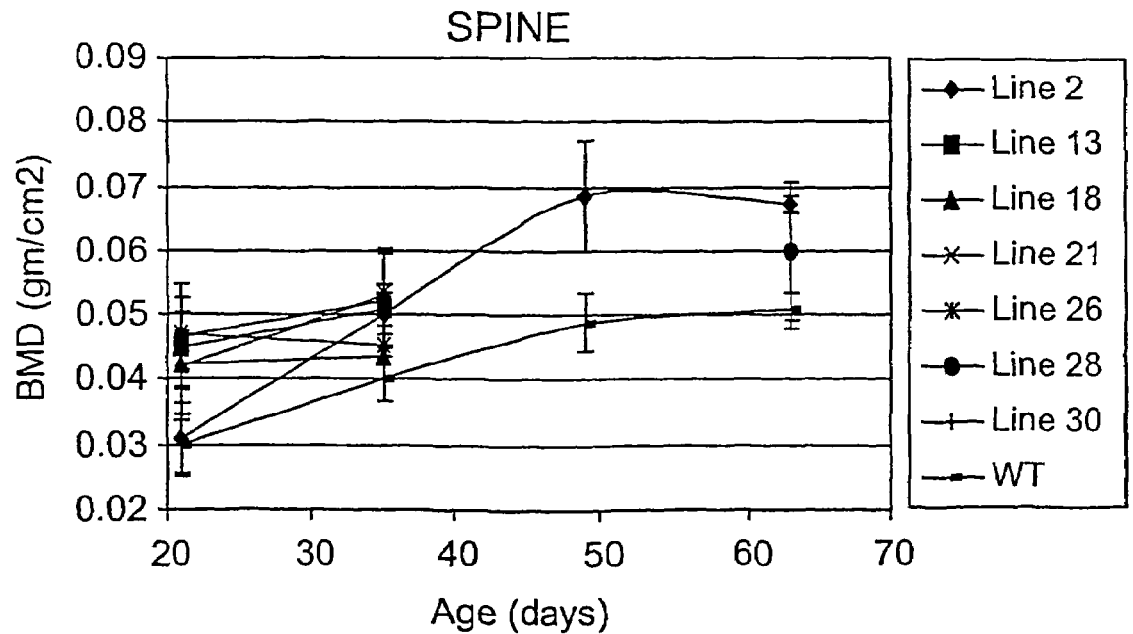
FIG. 20 depicts expression of HBM in transgenic mice based on mRNA expression analyzed by TaqMan®.
FIGS. 21A-F Panels A-C depict the analysis of various transgenic mouse lines which express the HBMMCBA construct in spine (FIG. 21A), femur (FIG. 21B) and total body (FIG. 21C). Panels D-F depict the analysis of various transgenic mouse lines which express the HBMMTIC construct in spine (FIG. 21D), femur (FIG. 21E) and total body (FIG. 21F).
Figure 21B:
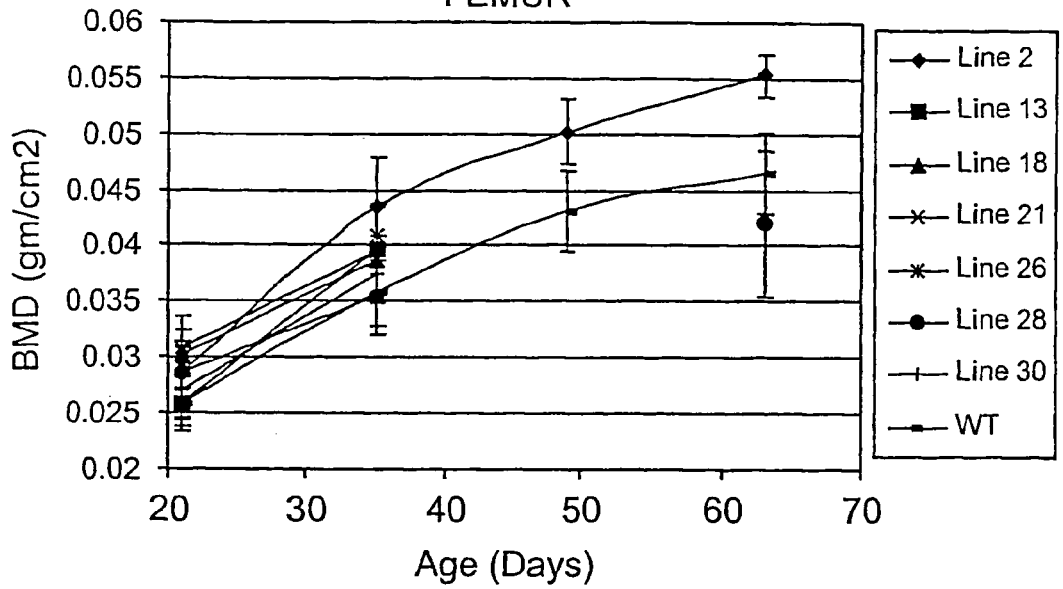
Figure 21C:
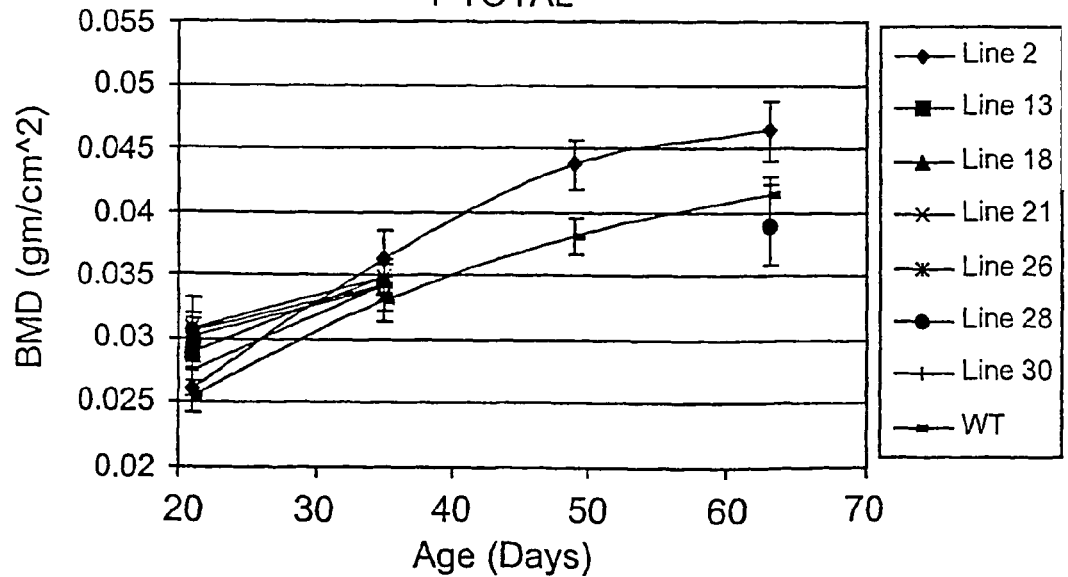
Figure 21D:
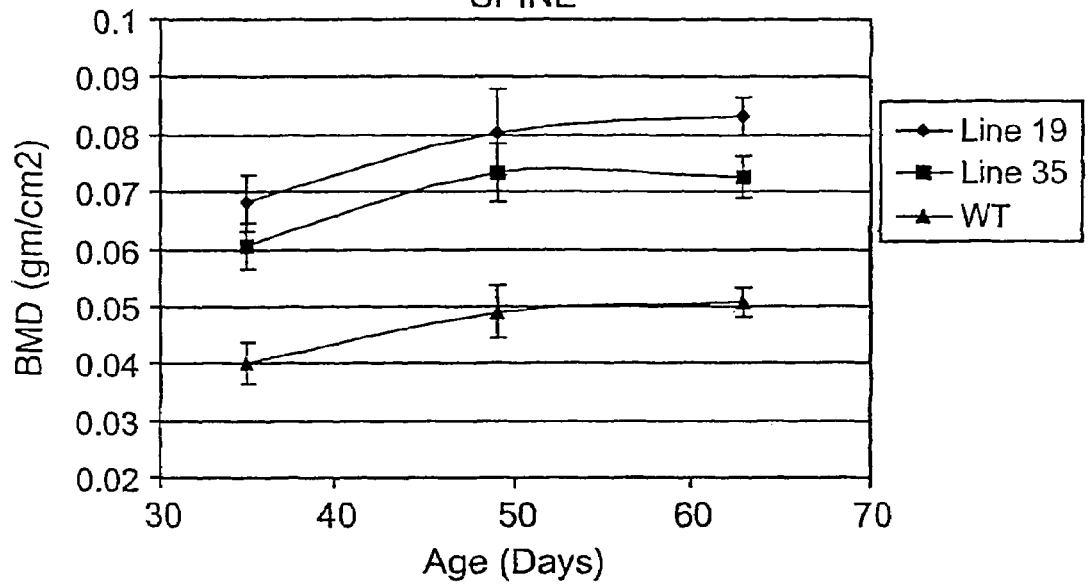
Figure 21E:
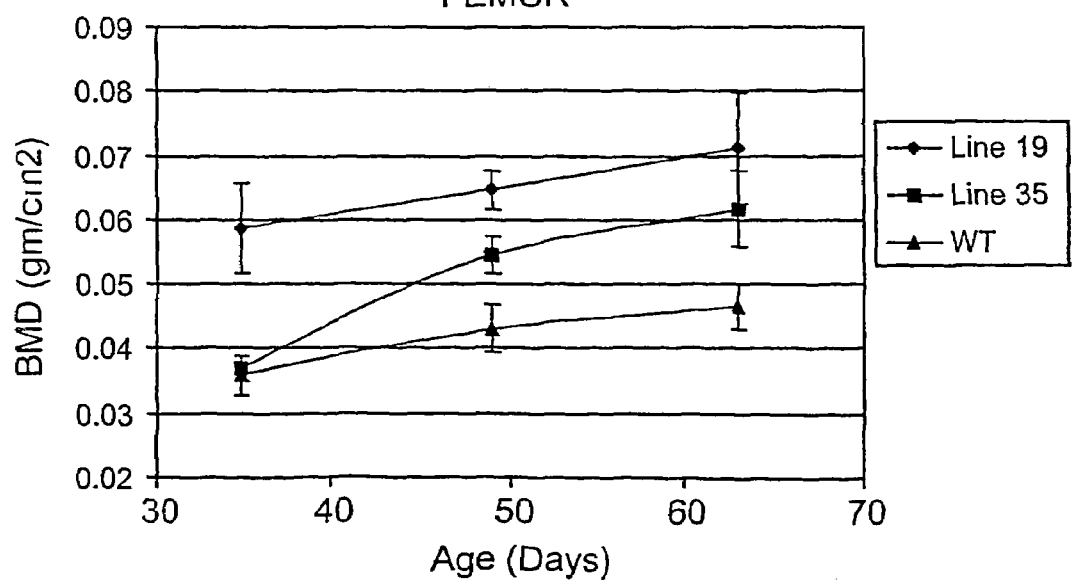
Figure 21F:
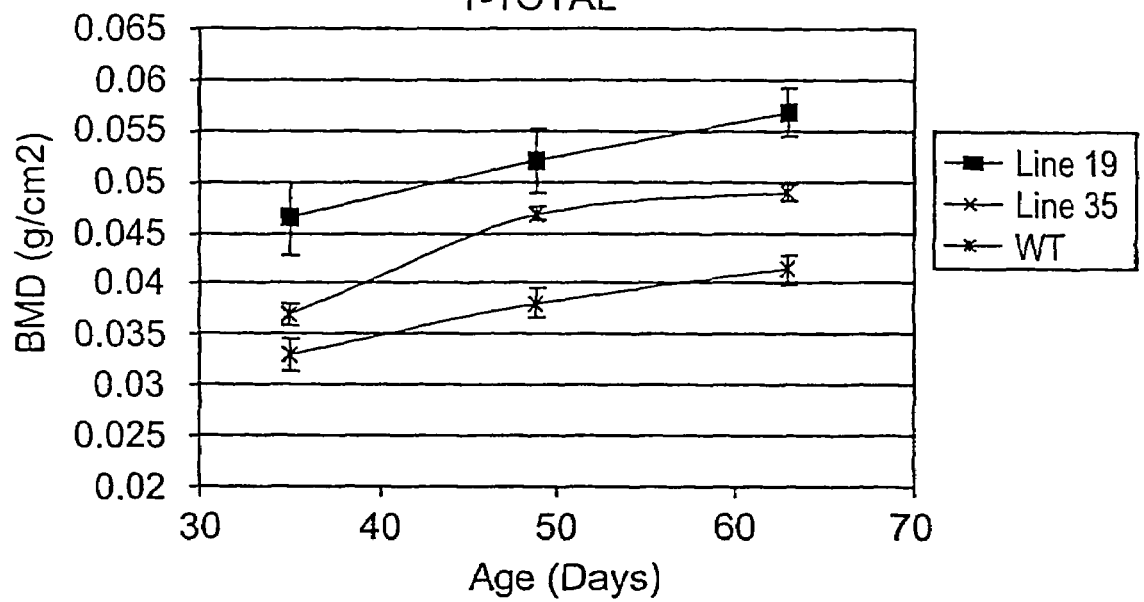

Eight transgenic founder animals were produced for the CMVbActin (HBMMCBA) construct and a breeding program initiated to establish lines. Expression of mRNA determined by TaqMan® analysis, shown in FIG. 20, showed variable levels of bone expression in 4 lines. In tibia, expression levels (relative to endogenous Zmax1 (LRP5) in HOB-03-C5 cells) showed the following range: line 18 (x10-11 fold); line 2 (x7-10 fold); line 13 (x1-2 fold) and line 28 (x1 fold). Expression was also detected in other tissues as expected based on the known activity of the promoter. For lines 2 and 13, the highest levels of HBM expression were found in the heart. A TaqMan® genotyping assay will screen for potential homozygous animals.

Six transgenic founder animals were produced for the type I collagen (HBMMTIC) construct, and a breeding program initiated to establish lines. Expression of mRNA was found in two lines initially tested. In line 19, expression was 7-8 fold and 19-20 fold greater than Zmax1 in HOB-03-C5 cells in tibia and femur, respectively. In line 35, a low level of expression was detected in tibia and femur.

21.9 In vivo pDXA in HBM Transgenic Mice 21.9.1 HBMMCBA Construct

Initial analysis of limited numbers of mice, illustrated in FIG. 21(A-C), at the 5 week and 9 week time-points showed that one line tested to date had greater BMD values compared to control. At 5 weeks, HBMMCBA line 2 (n=11) BMD in femur, spine and total body was 21%, 24% and 10% greater respectively, than wild-type control. At 9 weeks (n=3), these increases in BMD amounted to 19%, 32% and 12%, respectively.

21.9.2 HBMMTIC Construct

Analysis of limited numbers of mice, illustrated in FIG. 21(D-F), at the 5 week and 9 week time points showed that two lines tested to date had greater BMD values as compared to control. At 5 weeks, HBMMTIC line 19 (n=5) BMD in femur, spine and total body was 63%, 70% and 41% greater respectively than the wild-type control. At 9 weeks (n=2), these increases in BMD amounted to 52%, 64% and 37% respectively.

At 5 weeks, HBMMTIC line 35 (n=1) BMD in femur, spine and total body was 4%, 47% and 6% greater, respectively than the wild-type control. At 9 weeks (n=3), these increases in BMD amounted to 32%, 43% and 18% respectively.

These results indicate that three lines analyzed to date show evidence for a high bone mass phenotype. There appeared to be no obvious correlation between levels of mRNA expression and BMD phenotype from the limited numbers of lines and animals studied to date. For example, HBMMCBA line 2 and HBMMTIC line 19 have similar levels of HBM mRNA in tibia, but the phenotype is more evident in line 19. Also, HBMMTIC line 35 shows a very low level of expression when compared to HBMMCBA line 2, but HBMMTIC line 35 appears to have a stronger phenotype. These observations point to possible differences in cellular expression that may impact the phenotype.

Overall, the BMD results from the transgenic mice show similarities in magnitude to the phenotype observed in the HBM affected kindred (Johnson et al., 1997, *Am. J. Hum. Genetics*, 60:1326-1332). For example, spinal BMD measured in affected individuals is approximately 34-63% greater than non-affected family members. The data for spinal BMD from the transgenic animals ranges from ~30-70% greater than normal at 9 weeks of age.

21.9.3 Ex vivo Analysis of Transgenic Mice

In order to further examine increases in bone density that were detected in select transgenic lines through monitoring of the animals by non-invasive bone imaging, necropsies were performed on animals of these lines at 5 and 9 weeks of age for direct bone densitometric and histologic analysis. The left femur was isolated, cleaned and positioned in an XCT Research peripheral Quantitative Computed Tomograph (pQCT; Stradtec Medizintechnik, Pforzheim, Germany). The distal end of the femur was located and pQCT scarring was initiated 2.5 mm proximal from this point for total and trabecular measurements. The pQCT scan for cortical measurements was initiated 3.5 mm proximal from the first scan (i.e., 6 mm proximal from the distal end). The pQCT scans were 0.5 mm thick, had a voxel (i.e., three dimensional pixel) size of 0.07 mm, and consisted of 360 projections through the slice. After the scans were completed, the images were displayed on the monitor and a region of interest, including the entire femur for each scan, was outlined. The soft tissue was automatically removed using an iterative algorithm, and the density of the remaining bone (total density) in the first slice was determined. The outer 55% of the bone was then peeled away in a concentric spiral and the density of the remaining bone (trabecular density) of the first slice was reported in $mg/cm^3$. In the second slice, the boundary between cortical and trabecular bone was determined using an iterative algorithm, and the density of the cortical bone was determined.

Analysis of Line 2 F1 CMVbActin-HBM 5 week old transgenic animals revealed that total density, trabecular density and cortical density, were 20%, 37% and 4% higher, respectively, in the transgenic male mice versus the non-transgenic males. In-5 week old Line 19 type I collagen-HBM transgenic males, an even more dramatic increase in bone density over their non-transgenic littermates was evident. Total density, trabecular density and cortical density were 53%, 104% and 5% higher, respectively. In the Line 19 animals, the phenotype was found to be maintained at 9 weeks of age. with total, trabecular and cortical bone density being 44%, 101% and 6% higher than the non-transgenic littermates. At 17 weeks, total and trabecular density were increased 46%, 202%, respectively. The effects on the total trabecullar parameters in line 19 at all three time points were statistically sigiuficantly higher ($p<0.001$). A somewhat different pattern of bone phenotypic expression was evident from males of type I collagen-HBM transgenic Line 35. At 5 weeks of age total, trabecular and cortical density were only marginally higher. (7%, 4% and 4%, respectively). However, at 9 weeks of age a clear and statistically significant ($P<0.05$, 0.005, and 0.001 respectively) increase in these parameters became evident (i.e., 25%, 37% and 4%, respectively). The occurrence of different patterns of age-related expression of the phenotype is not unexpected, particularly with the "bone specific" type I collagen transgene, which is influenced by stage of bone cell differentiation. Both Line 2 and Line 19 animals at 5 weeks of age express comparable levels of HBM mRNA in tibia samples, and these levels are significantly greater (>7-8-fold) than other lines that show no apparent bone phenotype at this age. Line 19, which is driven by the type I collagen promoter, unlike line 2, shows very low expression of the transgene in tissues other than bone. At 5 weeks of age, Line 35 animals show low level expression in bone and none in other tissues. Immunohistochemistry of calvarial bone sections using an HBM/Zmax1 specific antibody reveals much more intense staining in bone cells of transgenic animals from Lines 2 and 19 at 5 weeks of age and from Line 35 at 9 weeks of age versus their non-transgenic littermates.

The findings revealed by pQCT analysis were further examined under greater resolution using μCT instrumentation (Scanco). The femur was positioned such that the region being imaged includes the distal end of the femur extending approximately 4 mm proximally with the view being perpendicular to the axis of the articulating cartilage. The reference line for beginning the μCT measurement was placed to minimally overlap the growth plate and extends proximally for 200 scan slices (9 mm thickness). After completing the μCT measurement, the first slice in which the condyles have fully merged was identified. A region of interest was outlined to include a maximum amount of the trabecular space, while excluding the cortex. For the first thirty slices, regions of interest were drawn every five slices and merged. For the remaining 105 slices, regions of interest were drawn every 10-20 slices. The more regular the trabecular space, the less frequently a region of interest needed to be drawn. Each region of interest was merged with its predecessor after it was drawn. After regions of interest had been established for all 135 slices, three dimensional evaluation was performed using a threshold setting of 350.

The increased bone densities identified by pQCT were confirmed and extended by μCT to include elements of bone architecture. In the Line 2 transgenic animals, μCT bone volume/total volume, connectivity density and trabecular thickness were 50%, 83% and 12% higher, respectively. Both the connectivity density and trabecular thickness indices suggest that the increased density is also associated with increased structural strength. Bone surface/bone volume was lower by 17% in the transgenic males, which may suggest that there may be fewer resorptive surfaces and pits. The trabecular bone response was further confirmed by. histological evaluation of non-decalcified, Goldner's stained sections, which revealed 36% greater bone mineral area in the distal femoral metaphysis of the transgenic males. Dynamic histomorphometric analysis revealed that a substantial increase in bone mineral apposition rate (+100%), as determined by calcein double labeling, may be partially responsible for the increased bone in the transgenics. The dramatic effects evident by pQCT on trabecular bone in Line 19 were supported by μCT evaluation where bone volume/total volume, trabecular number, trabecular thickness and connectivity density were found to be 130%, 45%, 30% and 121% higher, respectively, in,the transgenic males. As seen in Line 2, the bone surface/bone volume was lower in the transgenic males (−36%). All of these effects were statistically significant with $p<0.01$. The bone phenotype seen at 5 weeks of age in Line 19 was maintained in 9 week-old animals where bone volume/ total volume, trabecular number and connectivity density were 125%, 38% and 110% higher than in the non-transgenic littermiates.

μCT analysis of the Line 35 transgenics revealed a somewhat different pattern than the other two lines. In contrast to only modestly increased density indicated by pQCT in 5 week-old females from Line 35, a statistically significant effect ($p<0.01$) was seen with mCT, which has greater image resolution and encompasses a larger volumetric sample. Bone is volume/total volume, trabecular thickness and connectivity density were 35%, 9% and 27% higher. A similar result was seen in 5 week-old males from Line 35 where bone volume/total volume and connectivity density increases of 37% and 45%, respectively, were evident by μCT analysis, where only slight increases were revealed by pQCT. The differences between the Line 35 transgenic males and their non-transgenic littermates appeared to increase with age such that statistically significant increases in total density (25%) and trabecular density (37%) were evident by pQCT at 9 weeks of age. The μCT results support an age-related divergence in bone phenotype in this line and show that differences between transgenic and non-transgenic animals, in terms of bone volume/total volume and connectivity density, had nearly doubled those seen at 5 weeks to 70% and 83%, respectively. The bone volume increases seen in the transgenic animals is in agreement with a significant increase in this parameter that was detected in a bone biopsy sample from an adult male affected member of the HBM kindred. The other parameters that were found to be affected in the transgenic lines may reflect changes that lead to an increased peak/adult bone mass, which in this strain of mice occurs between the ages of 17-20 weeks The bone density and bone architectural changes seen in the over-expressing transgenic lines would suggest potentially greater bio-mechanical strength. This was tested directly by evaluating 3-point bending strength of femurs from 5 week old Line 19 males. The femora were cleaned of soft tissue and the femoral length measured using a digital caliper. Periosteal and endosteal circumferences, as well as cortical thickness, were measured 6 mm from the distal end of the bone using pQCT. The femur was then placed on a fixture so that the center of mid-shaft was at an equal distance from fixed supports located 5 mm apart. The cross bar of an Instron 5543 load device was placed over the mid-shaft and a force applied at a speed of 1 mm/minute until fracture occurred. A force vs. displacement curve was generated and peak load determined using Instron Merlin software. There was a 75% increase ($p<0.01$) in strength that appears to be due to an increase in periosteal circumference leading to an increase in cortical thickness. Thus, it appears that the changes in bone density and bone geometry, as seen in the HBM transgenic animals, do translate into increases in biomechanical strength.

In view of the association of HBM/Zmax1 within the class of LDL related receptor proteins, it was of interest to determine whether the mutation night affect lipid profiles. Indeed, lipid studies in the HBM kindred (i.e., 8 affected and 7 unaffected members) have revealed that triglyceride and VLDL levels are statistically lower in the affected members. Serum samples from the transgenic lines were analyzed on a Hitachi 911 instrument using Boehringer Mannheim (for Cholesterol) and Roche (for triglycerides) reagents. The cholesterol was measured via o-quinone imine dye (which is formed following enzymatic reactions with cholesterol) photometrically at 505 nm at 37° C. Enzymatic methods for triglyceride measurements are based on determination of the glycerol part of triglyceride after hydrolysis of triglycerides and fatty acids. The end dye product of enzymatic reaction was measured at 505 nm. In 5 week old male Line 2 transgenics, although serum cholesterol was only slightly reduced, serum triglyceride levels were reduced by 26% in the transgenics versus their non-transgenic littermates. In a limited sample of Line 2 animals at 9 weeks of age, triglyceride levels remained 20% lower. Similarly, at 5 weeks of age triglyceride levels in male transgenics from Line 19 were 32% lower. In contrast, at 5 weeks of age both male and female transgenics of Line 35 did not have lower triglyceride levels. The fact that the 5 week old Line 35 animals did have statistically greater bone volume/total volume suggests that the lipid change may not be directly related to the skeletal phenotype. This would appear to be supported by the fact that the Line 35 animals at 9 weeks of age had only slightly reduced triglyceride levels (11%) but exhibited substantially higher bone density than at 5 weeks of age. Due to the different levels and sites of expression of the transgene in these lines we can not rule out the possibility that serum lipid levels could serve as a surrogate marker for agents favorably affecting a bone phenotype through HBM/Zmax1.

These and other transgenic lines based on HBM or HBM-like genes will serve as valuable models for exploring the nature of bone homeostasis. Bone density in all species accommodates to its customary loading conditions. In the HBM kindred and in the transgenic lines, the sensor/effector systems of the skeleton appear to perceive greater load signals resulting in greater bone density. Experimental models have been established showing that increased bone loading can lead to increased bone density and that unloading or disuse leads to a loss of bone density. Evaluating the histological, biochemical and genetic responses of the skeleton of the transgenic animals in these experimental paradigms will yield much information regarding the sensor/effector system responsible for bone homeostasis. The application of the transgenic animals in other established models of altered bone turnover, including but not limited to steroid deficiency-induced osteopenia and aging-related osteopenia will provide further insight into the role of Zmax1 in bone homeostasis and the nature of the favorable changes induced by the HBM mutation.

21.9.4 HBM Gene-targeting

The Zmax1 KI/KO gene-targeting vector is electroporated into 129 SvEv, C57BL/6 ES and 129 ES cells. Restriction fragment length analysis of genomic DNA and sequencing of PCR amplified fragments can be used to identify gene targeted clones. The knock-in version of the Gene-targeting vector allows for the introduction of the HBM mutation into the endogenous Zmax (LRP5) genomic locus with minimal impact on the mouse genome. It permits the production of the HBM protein in a more natural environment, i.e. not in an over-expression model such as the transgenic mice or transfected cell lines. The knock-out version of the gene-targeting vector was engineered to contain a transcriptional stop sequence that has the potential to result in loss of one functional LRP5 allele. Breeding heterozygous animals with this mutation would lead to the production of embryos homozygous for the null allele. In a different design of the gene-targeting vector, lox P sites could be positioned in such a way that would facilitate production of a conditional knock-out of the endogenous LRP5 gene. In the presence of Cre recombinase, a critical region of the LRP5 gene would be deleted in between the lox P sites, thus resulting in the potential loss of one functional allele. Animal breeding would then be used to create homozygotes with a null allele. Other recombinase enzyme systems, such as flp recombinase in combination with cognate frt sites, could be used to create the deletion. The recombinase could be administered in a number of ways as described earlier, including plasmid injection into embryos and use of transgenic animals expressing Cre. The promoter used to drive expression of Cre could be chosen in a manner that would result in ubiquitous or tissue-specific deletion of the LRP5 gene thus resulting in a conditional knockout. In a further embodiment expression of the Cre enzyme itself could be made conditional using inducible systems such as GeneSwitch and Tetracycline paradigms.

21.9.5 1 Uses of Transgenic Animals and Cells

The transgenic animals and cells of the present invention are useful tools in methods for identifying surrogate markers for the HBM phenotype. The surrogate markers provided by the present invention are also useful tools for the assessment and screening of prospective treatments. Individuals carrying the HBM gene have elevated bone mass. The HBM gene causes this phenotype by altering the activities, levels, expression patterns, and modification states of other molecules involved in bone development. Using a variety of established techniques, it is possible to identify molecules, preferably proteins or mRNAs, whose activities, levels, expression patterns, and modification states are different between systems containing the Zmax1 gene and systems containing the HBM gene. Such systems can be, for example, cell-free extracts, cells, tissues or living organisms, such as mice or humans. For a mutant form of Zmax1, a complete deletion of Zmax1, mutations lackcing the extracellular or intracellular portion of the protein, or any other mutation in the Zmax1 gene may be used. It is also possible to use expression of antisense Zmax1 RNA or oligonucleotides to inhibit production of the Zmax1 protein. For a mutant form of HBM, a complete deletion of HBM, mutations lacking the extracellular or intracellular portion of the HBM protein, or any other mutation in the HBM gene may be used. It is also possible to use expression of antisense HBM RNA or oligonucleotides to inhibit production of the HBM protein.

Molecules identified by comparison of Zmax1 systems and HBM systems can be used as surrogate markers in pharmaceutical development or in diagnosis of human or animal bone disease. Alternatively, such molecules may be used in treatment of bone disease. See, Schena et al., 1995 *Science,* 270: 467-70.

For example, a transgenic mouse carrying the HBM gene or HBM-like variant in the mouse homologue locus is constructed. A mouse of the genotype HBM/+ is viable, healthy and has elevated bone mass. To identify surrogate markers for elevated bone mass, HBM/+ (i.e., heterozygous) and isogenic +/+ (i.e., wild-type) mice are sacrificed. Bone tissue mRNA is extracted from each animal, and a "gene chip" corresponding to mRNAs expressed in the +/+ individual is constructed. mRNA from different tissues is isolated from animals of each genotype, reverse-transcribed, fluorescently labeled, and then hybridized to gene fragments affixed to a solid support. The ratio of fluorescent intensity between the two populations is indicative of the relative abundance of the specific mRNAs in the +/+ and HBM/+ animals. Alternatively, mRNA may be isolated from wild-type and transgenic animals. cDNA prepared from these samples is transcribed in vitro to obtain labeled mRNA for use on custom made or commercially available gene array chips such as are manufactured by Affymetrix. Sets of genes with altered expression as a function of phenotype may be identified be a variety of routine computational analyses. Genes encoding mRNA over- and under-expressed relative to the wild-type control are candidates for genes coordinately regulated by the HBM gene or HBM-like gene.

One standard procedure for identification of new proteins that are part of the same signaling cascade as an already-discovered protein is as follows. Cells are treated with radioactive phosphorous, and the already-discovered protein is manipulated to be more or less active. The phosphorylation state of other proteins in the cell is then monitored by polyacrylamide gel electrophoresis and autoradiography, or similar techniques. Levels of activity of the known protein may be manipulated by many methods, including, for example, comparing wild-type mutant proteins using specific inhibitors such as drugs or antibodies, simply adding or not adding a known extracellular protein, or using antisense inhibition of the expression of the known protein (Tamura et al., 1998 *Science,* 280: 1614-7; Meng, 1998 *EMBO J.,* 17: 4391-403; Cooper et al., 1982 *Cell* 1: 263-73).

In another example, proteins with different levels of phosphorylation are identified in TE85 osteosarcoma cells expressing either a sense or antisense cDNA for Zmax1. TE85 cells normally express high levels of Zmax1 (Dong et al., 1998 *Biochem. & Biophys. Res. Comm.,* 251: 784-90). Cells containing the sense construct express even higher levels of Zmax1, while cells expressing the antisense construct express lower levels. Cells are grown in the presence of $^{32}P$, harvested, lysed, and the lysates run on SDS polyacrylamide gels to separate proteins, and the gels subjected to autoradiography (Ausubel et al., *Current Protocols in Molecular Biology,* John Wiley & Sons (1997)). Bands that differ in intensity between the sense and antisense cell lines represent phosphoproteins whose phosphorylation state or absolute level varies in response to levels of Zmax1. As an alternative to the $^{32}P$-labeling, unlabeled proteins may be separated by SDS-PAGE and subjected to immunoblotting, using the commercially available anti-phosphotyrosine antibody as a probe (Thomas et al., .1995 *Nature,* 376: 267-71). As an alternative to the expression of antisense RNA, transfection with chemically modified antisense oligonucleotides can be used (Woolf et al., 1990 *Nucleic Acids Res.,* 18: 1763-9).

Many bone disorders, such as osteoporosis, have a slow onset and a slow response to treatment. It is therefore useful to develop surrogate markers for bone development and mineralization. Such markers can be useful in developing treatments for bone disorders, and for diagnosing patients who may be at risk for later development of bone disorders. Examples of preferred markers are N- and C-terminal telopeptide markers described, for example, in U.S. Pat. Nos. 5,455,179, 5,641,837 and 5,652,112, the disclosures of which are incorporated by reference herein in their entirety. In the area of HIV disease, CD4 counts and viral load are useful surrogate markers for disease progression (Vlahov et al., 1998 *JAMA,* 279(1): 35-40). There is a need for analogous surrogate markers in the area of bone disease.

A surrogate marker can be any characteristic that is easily tested and relatively insensitive to non-specific influences. For example, a surrogate marker can be a molecule such as a protein or mRNA in a tissue or in blood serum. Alternatively, a surrogate marker may be a diagnostic sign such as sensitivity to pain, a reflex response or the like.

In yet another example, surrogate markers for elevated bone mass are identified using a pedigree of humans carrying the HBM gene or HBM-like gene. Blood samples are withdrawn from three individuals that carry the HBM gene or HBM-like gene, and from three closely related individuals that do not. Proteins in the serum from these individuals are electrophoresed on a two dimensional gel system, in which one dimension separates proteins by size, and another dimension separates proteins by isoelectric point (Epstein et al., 1996 *Electrophoresis* 17: 1655-70). Spots corresponding to proteins are identified. A few spots are expected to be present in different amounts or in slightly different positions for the HBM individuals compared to their normal relatives. These spots correspond to proteins that are candidate surrogate markers. The identities of the proteins are determined by microsequencing, and antibodies to the proteins can be produced by standard methods for use in diagnostic testing procedures. Diagnostic assays for HBM proteins or other candidate surrogate markers include using antibodies described in this invention and a reporter molecule to detect HBM in human body fluids, membranes, bones, cells, tissues or extracts thereof. The antibodies can be labeled by joining them covalently or noncovalently with a substance that provides a detectable signal. In many scientific and patent literature, a variety of reporter molecules or labels are described including radionuclides, enzymes, fluorescent, chemiluminescent or chromogenic agents (U.S. Pat. Nos. 3,817,837; 3,850,752; 3,939,350; 3,996,345; 4,277,437; 4,275,149; and 4,366,241). The transgenic or genetically modified animals can also serve in a method for surrogate marker identification.

Using these antibodies, the levels of candidate surrogate markers are measured in normal individuals and in patients suffering from a bone disorder, such as osteoporosis, osteoporosis pseudoglioma, Engelmann's disease, Ribbing's disease, hyperphosphatasemia, Van Buchem's disease, melorheostosis, osteopetrosis, pychodysostosis, sclerosteosis, osteopoikilosis, acromegaly, Paget's disease, fibrous dysplasia, tubular stenosis, osteogenesis imperfecta, hypoparathyroidism, pseudohypoparathyroidism, pseudopseudohypoparathyroidism, primary and secondary hyperparathyroidism and associated syndromes, hypercalciuria, medullary carcinoma of the thyroid gland, osteomalacia and other diseases. Techniques for measuring levels of protein in serum in a clinical setting using antibodies are well established. A protein that is consistently present in higher or lower levels in individuals carrying a particular disease or type of disease is a useful surrogate marker.

A surrogate marker can be used in diagnosis of a bone disorder. For example, consider a child that presents to a physician with a high frequency of bone fracture. The underlying cause may be child abuse, inappropriate behavior by the child, or a bone disorder. To rapidly test for a bone disorder, the levels of the surrogate marker protein are measured using the antibody described above.

Levels of modification states of surrogate markers can be measured as indicators of the likely effectiveness of a drug that is being developed. It is especially convenient to use surrogate markers in creating treatments for bone disorders, because alterations in bone development or mineralization may require a long time to be observed. For example, a set of bone mRNAs, termed the "HBM-inducible mRNA set" is found to be over-expressed in HBM/+ mice as compared to +/+ mice, as described above. Expression of this set can be used as a surrogate marker. Specifically, if treatment of +/+ mice with a compound results in over-expression of the HBM-inducible mRNA set, then that compound is considered a promising candidate for further development.

This invention is particularly useful for screening compounds by using the Zmax1 or HBM protein or HBM-like proteins or binding fragments thereof in any of a variety of drug screening techniques.

The Zmax1 or HBM protein or fragment employed in such a test may either be free in solution, affixed to a solid support, or borne on a cell surface. One method of drug screening utilizes eukaryotic or prokaryotic host cells which are stably transformed with recombinant nucleic acids expressing the protein or fragment, preferably in competitive binding assays. Such cells, either in viable or fixed form, can be used for standard binding assays. One may measure, for example, for the formation of complexes between a Zmax1 or HBM protein or fragment and the agent being tested, or examine the degree to which the formation of a complex between a Zmax1 or HBM protein or fragment and a known ligand is interfered with by the agent being tested.

Thus, the present invention provides methods of screening for drugs comprising contacting such an agent with a Zmax1 (LRP5) or HBM protein or fragment thereof and assaying (i) for the presence of a complex between the agent and the Zmax1 or HBM protein or fragment, or (ii) for the presence of a complex between the Zmax1 or HBM protein or fragment and a ligand, by methods well known in the art. In such competitive binding assays the Zmax1 or HBM protein or fragment is typically labeled. Free Zmax1 or HBM protein or fragment is separated from that present in a protein:protein complex, and the amount of free (i.e., uncomplexed) label is a measure of the binding of the agent being tested to Zmax1 or HBM or its interference with Zmax1 or HBM: ligand binding, respectively.

Another technique for drug screening provides high throughput screening for compounds having suitable binding affinity to the Zmax1 or HBM proteins and is described in detail in WO 84/03564. Briefly stated, large numbers of different small peptide test compounds are synthesized on a solid substrate, such as plastic pins or some other surface. The peptide test compounds are reacted with Zmax1 or HBM proteins and washed. Bound Zmax1 or HBM protein is then detected by methods well known in the art. Purified Zmax1 or HBM can be coated directly onto plates for use in the aforementioned drug screening techniques. However, non-neutralizing antibodies to the protein can be used to capture antibodies to immobilize the Zmax1 or HBM protein on the solid phase.

This invention also contemplates the use of competitive drug screening assays in which neutralizing antibodies capable of specifically binding the Zmax1 or HBM protein compete with a test compound for binding to the Zmax1 or HBM protein or fragments thereof. In this manner, the antibodies can be used to detect the presence of any peptide that shares one or more antigenic determinants of the Zmax1 or HBM protein.

A further technique for drug screening involves the use of host eukaryotic cell lines or cells (such as described above) that have a nonfunctional Zmax1 or HBM gene. These host cell lines or cells are defective at the Zmax1 or HBM protein level. The host cell lines or cells are grown in the presence of drug compound. The rate of growth of the host cells is measured to determine if the compound is capable of regulating the growth of Zmax1 or HBM defective cells.

The goal of rational drug design is to produce structural analogs of biologically active proteins of interest or of small molecules with which they interact (e.g., agonists, antagonists, inhibitors) in order to fashion drugs which are, for example, more active or stable forms of the protein, or which, e.g., enhance or interfere with the function of a protein in vivo. See, e.g., Hodgson, 1991 *Bio/Technology*, 9: 19-21. In one approach, one first determines the three-dimensional structure of a protein of interest (e.g., Zmax1 or HBM protein) or, for example, of the Zmax1- or HBM-receptor or ligand complex, by x-ray crystallography, by computer modeling or most typically, by a combination of approaches. Less often, useful information regarding the structure of a protein may be gained by modeling based on the structure of homologous proteins. An example of rational drug design is the development of HIV protease inhibitors (Erickson et al., 1990 *Science*, 249: 527-33). In addition, peptides (e.g., Zmax1 or HBM protein) are analyzed by an alanine scan (Wells, 1991

*Methods in Enzymol.*, 202: 390-411). In this technique, an amino acid residue is replaced by Ala, and its effect on the peptide's activity is determined. Each of the amino acid residues of the peptide is analyzed in this manner to determine the important regions of the peptide.

It is also possible to isolate a target-specific antibody, selected by a functional assay, and then to solve its crystal structure. In principle, this approach yields a pharmacore upon which subsequent drug design can be based. It is possible to bypass protein crystallography altogether by generating anti-idiotypic antibodies (anti-ids) to a functional, pharmacologically active antibody. As a mirror image of a mirror image, the binding site of the anti-ids would be expected to be an analog of the original receptor. The anti-id could then be used to identify and isolate peptides from banks of chemically or biologically produced banks of peptides. Selected peptides would then act as the pharmacore.

Thus, one may design drugs which have, e.g., improved Zmax1 or HBM protein activity or stability or which act as inhibitors, agonists, antagonists, etc. of Zmax1 or HBM protein activity. By virtue of the availability of cloned Zmax1 or HBM sequences, sufficient amounts of the Zmax1 or HBM protein may be made available to perform such analytical studies as X-ray crystallography. In addition, the knowledge of the Zmax1 or HBM protein sequence provided herein will guide those employing computer modeling techniques in place of, or in addition to X-ray crystallography.

Identified drug candidates (known as "leads") may be further studied by use of transgenic animals. The transgenic animals of the present invention are useful for creating an animal model of bone density modulation which may be used to test and refine drug leads. The transgenic animals described above represent a single example of the Zmax1 and HBM or HBM-like transgenic animals contemplated herein. One skilled in the art is aware of variations and the considerations which will be routinely applied in modifying the present invention to a specific purpose. Examples of the development of transgenic animal models are given for example in *Strategies in Transgenic Animal Science* (1995, Monastersky and Robl Eds., Washington, D.C.: American Society for Microbiology) and references therein which are all incorporated herein by reference in their entirety.

As an example, at least two groups of transgenic animals can be created as described, so that one group expresses HBM and another group expresses Zmax1. These animals can be treated with the candidate drug for some time spanning from a few days to the remainder of the animal's life-span. The animals are monitored for changes in bone mass and/or surrogate markers for the HBM phenotype. The transgenic animals used in such a study may express human HBM protein and Zmax1 protein or the homologous HBM and Zmax1 proteins defined for each species or variants thereof. Expression may be driven by a ubiquitous promoter or a bone specific promoter as would be known. It will be informative to compare groups of animals utilizing different promoters.

The transgenic animals of the method according to the present inventions may also comprise knock-in (KI) and/or knock-out (KO) animals, such as mice, which express HBM, Zmax1, or neither under the control of the animal's native promoter. Such animals may be created by homologous recombination in ES cells as described above (and elsewhere in the literature of the art such as, for example, U.S. Pat. Nos. 6,187,991 and 6,187,992 and references cited therein which are incorporated herein in their entirety). The experimental groups of transgenic animals treated with candidate drugs may be monitored by non-invasive means, by the monitoring of surrogate markers as described above, and/or by ex vivo analysis of bones from sacrificed animals at given timepoints.

Likewise the effect of such treatments as dietary control (e.g. varying intake of vitamins, minerals, proteins, lipids, etc.), ovariectomy, direct administration of all or part of purified HBM or Zmax1 proteins, administration of antisense nucleotides, antibodies against Zmax1 or gene therapy in adults may be investigated by systematic administration of the treatment to transgenic animals according to the invention. Such treatments may include, administration of estrogens, tamoxifen, raloxifene, (or other selective estrogen modulators, SERMs), vitamin D analogs, calcitonin, cathepsin K inhibitors, statins (e.g. simvastatin, pravastatin, and lovastatin), bis-phosphonates, parathyroid hormone (PTH), bone morphogenetic proteins (BMP) as described in U.S. Pat. Nos. 6,190,880 and 5,866,364, and combinations of the above compounds.

In view of the homology between Zmax1 and LRP6 and to the LDL receptor and the further observations of markers for cardiac health being modulated in HBM subjects, it is an aspect of the present invention to use the novel research methods disclosed herein to screen known cardio-protective treatments for bone modulating effects. Thereby, the present invention provides therapeutic methods which are both cardio-protective and which improve bone quality. The models are useful for testing drugs and researching lipid modulation effects related to Zmax1, LRP6, HBM and HBM like proteins and nucleic acids.

The effect of various mutations of Zmax1, HBM and HBM-like genes may be investigated by creation of additional lines of transgenic animals according to the invention, wherein these animals comprise such mutations. By comparison of direct measures of bone development or surrogate markers, an embodiment of the invention provides a useful research tool for screening gene therapy reagents, candidate drug therapies, and elucidating molecular mechanisms of bone development modulation. One skilled in the art knows how to use the methods of the present invention to achieve these goals.

The present invention provides a method and useful research tools for testing prospective gene therapies. Transgenic knock-out mice are useful for testing prospective gene therapies. A transgenic knock-out animal such as a mouse is created as described above which does not express endogenous Zmax1 or HBM. A prospective gene therapy, such as intravenous injection of a recombinant replication-defective adenovirus encoding the human HBM protein driven by the CMVβActin promoter, is administered. Parameters of bone density and/or surrogate markers are monitored over time following therapy (Ishibashi et al., 1993 *J. Clin. Invest.* 92: 883-93) A TaqMan® primer set such as that described above may be used to measure expression of transgenic HBM. One skilled in the art knows alternative methods such as the Northern blot method. Comparison of treated and untreated animals both within and between groups of germ-line transgenic animals, knock-out (null allele) background, and wild-type endogenous Zmax1 background animals provides complementary controls for assessing the relative effectiveness of various modalities of gene therapy.

Uses for the transgenic animals models contemplated herein also include, but are not limited to: (1) sources for generating bone cell cultures from the calvaria of the transgenic animals to study bone cell (e.g., osteoblast and osteoclast) function and number; (2) models for studying the effects of estrogen loss by ovariectomizing (ovx) the transgenic animals; (3) models for testing mechanical loading on the bones and other stress/strength tests; (4). breeding models with which to breed to other genetically modified or naturally occurring mutant animals that display bone abnormalities; (Chipman et al., 1993 *PNAS*, 90: 1701-05; Phillips et al., 2000 *Bone* 27: 219-26; Kajkenova et al., 1997 *J. Bone Min. Res.* 12: 1772-79; Jilka et al., 1996 *J. Clin. Invest.* 97: 1732-40; Takahashi et al., 1994 *Bone and Mineral* 24: 245-55); (5) bone mis/disuse models to test the effects of weight bearing or gravity; (6) models for identifying and screening reagents which may or are known to modulate bone metabolism (e.g., PTH, estrogen, vitamin D analogs, bisphosphonates, statins, leptin, BMP, apoE); (7) models for investigating prospective treatments to improve fracture repair.

The Transgenic animal models can be analyzed using, but not limited to, such methods as bone densitometry by pDEXA, pQCT and microCT; histology, molecular marker analysis, apoptosis, cell proliferation, cell cycle, mineralization, serum biochemistry, transcriptional profiling, and the like.

22. Methods of Use: Avian and Mammalian Animal Husbandry

The Zmax1 (LRP5) DNA and Zmax1 (LRP5) protein and/or the HBM DNA and HBM protein (or LRP6 or an HBM-like nucleic acid or protein as also contemplated herein) can be used for vertebrate and preferably human therapeutic agents and for avian and mammalian veterinary agents, including for livestock breeding. Birds, including, for example, chickens, roosters, hens, turkeys, ostriches, ducks, pheasants and quails, can benefit from the identification of the gene and pathway for high bone mass. In many examples cited in literature (for example, McCoy et al., 1996 *Res. Vet. Sci.*, 60: 185-6), weakened bones due to husbandry conditions cause cage layer fatigue, osteoporosis and high mortality rates. Additional therapeutic agents to treat osteoporosis or other bone disorders in birds can have considerable beneficial effects on avian welfare and the economic conditions of the livestock industry, including, for example, meat and egg production.

23. Methods of Use: Diagnostic Assays using Zmax1-specific Oligonucleotides for Detection of Genetic Alterations Affecting Bone Development In cases where an alteration or disease of bone development is suspected to involve an alteration of the Zmax1, LRP6, HBM or HBM-like gene, specific oligonucleotides may be constructed and used to assess the level of Zmax1 mRNA or HBM mRNA, respectively, in bone tissue or in another tissue that affects bone development.

For example, to test whether a person has the HBM gene, which affects bone density, polymerase chain reaction can be used. Two oligonucleotides are synthesized by standard methods or are obtained from a commercial supplier of custom-made oligonucleotides. The length and base composition are determined by standard criteria using the Oligo 4.0 primer Picking program (Wojchich Rychlik, 1992) or any suitable alternative. One of the oligonucleotides is designed so that it will hybridize only to HBM DNA under the PCR conditions used. The other oligonucleotide is designed to hybridize a segment of Zmax1 genomic DNA such that amplification of DNA using these oligonucleotide primers produces a conveniently identified DNA fragment. For example, the pair of primers CCAAGTTCTGAGAAGTCC (SEQ ID NO:32) and AATACCTGAAACCATACCTG (SEQ ID NO:33) will amplify a 530 base pair DNA fragment from a DNA sample when the following conditions are used: step 1 at 95° C. for 120 seconds; step 2 at 95° C. for 30 seconds; step 3 at 58° C. for 30 seconds; step 4 at 72° C. for 120 seconds; where steps 2-4 are repeated 35 times. Tissue samples may be obtained from hair follicles, whole blood, or the buccal cavity.

The fragment generated by the above procedure is sequenced by standard techniques. Individuals heterozygous for the HBM gene will show an equal amount of G and T at the second position in the codon for glycine 171. Normal or homozygous wild-type individuals will show only G at this position. Similar routine procedures may be used to develop assays for other polymorphisms and variants according to the invention.

Other amplification techniques besides PCR may be used as alternatives, such as ligation-mediated PCR or techniques involving Q-beta replicase (Cahill et al., *Clin. Chem.*, 37(9): 1482-5 (1991)). For example, the oligonucleotides 5'-AGCT-GCTCGTAGCTG TCTCTCCCTGGATCACGGGTACAT-GTACTGGACAGACTGGGT-3' (SEQ ID NO:34) and T5'-GAGACGCCCCGGATTGAGCGGGCAGGGATAGCTTA TTCCCTGTGCCGCA TTACGGC-3' (SEQ ID NO: 35) can be hybridized to a denatured human DNA sample, treated with a DNA ligase, and then subjected to PCR amplification using the primer oligonucleotides 5'-AGCTGCTCGTAGCT-GTCTCTCCCTGGA-3' (SEQ ID NO:36) and 5'-GCCG-TAATGCGGCACAGGGAATAAGCT-3' (SEQ ID NO:37). In the first two oligonucleotides, the outer 27 bases are random sequence corresponding to primer binding sites, and the inner 30 bases correspond to sequences in the Zmax1 gene. The T at the end of the first oligonucleotide corresponds to the HBM gene. The first two oligonucleotides are ligated only when hybridized to human DNA carrying the HBM gene, which results in the formation of an amplifiable 114 bp DNA fragment.

Products of amplification can be detected by agarose gel electrophoresis, quantitative hybridization, or equivalent techniques for nucleic acid detection known to one skilled in the art of molecular biology (Sambrook et al., *Molecular Cloning: A Laboratory Manual*, Cold Spring Harbor Laboratory, Cold Spring, N.Y. (1989)).

Other alterations in the Zmax1 gene or the HBM gene (or LRP6 or HBM-like nucleic acids, which are also contemplated herein) may be diagnosed by the same type of amplification-detection procedures, by using oligonucleotides designed to identify those alterations. These procedures can be used in animals as well as humans to identify alterations in Zmax1 or HBM that affect bone development.

Expression of Zmax1 or HBM in bone tissue may be accomplished by fusing the cDNA of Zmax1 or HBM, respectively, to a bone-specific promoter in the context of a vector for genetically engineering vertebrate cells. DNA constructs are introduced into cells by packaging the DNA into virus capsids, by the use of cationic liposomes, electroporation, or by calcium phosphate transfection. Transfected cells, preferably osteoblasts, may be studied in culture or may be introduced into bone tissue in animals by direct injection into bone or by intravenous injection of osteoblasts, followed by incorporation into bone tissue (Ko et al., 1996 *Cancer Res.* 56: 4614-9). For example, the osteocalcin promoter, which is specifically active in osteoblasts, may be used to direct transcription of the Zmax1 gene or the HBM gene. Any of several vectors and transfection methods may be used, such as retroviral vectors, adenovirus vectors, or vectors that are maintained after transfection using cationic liposomes, or other methods and vectors described herein.

Alteration of the level of functional Zmax1 protein or HBM protein affects the level of bone mineralization. By manipulating levels of functional Zmax1 protein or HBM protein, it is possible to affect bone development and to increase or decrease levels of bone mineralization. For example, it may be useful to increase bone mineralization in patients with osteoporosis. Alternatively, it may be useful to decrease bone mineralization in patients with osteopetrosis or Paget's disease. Alteration of Zmax1 levels or HBM levels can also be used as a research tool. Specifically, it is possible to identify proteins, mRNA and other molecules whose level or modification status is altered in response to changes in functional levels of Zmax1 or HBM. The pathology and pathogenesis of bone disorders is known and described, for example, in Rubin and Farber (Eds.), *Pathology*, 2nd Ed., S. B. Lippincott Co., Philadelphia, Pa. (1994).

A variety of techniques can be used to alter the levels of functional Zmax1 or HBM. For example, intravenous or intraosseous injection of the extracellular portion of Zmax1 or mutations thereof, or HBM or mutations thereof, will alter the level of Zmax1 activity or HBM activity, respectively, in the body of the treated human, animal or bird. Truncated versions of the Zmax1 protein or HBM protein can also be injected to alter the levels of functional Zmax1 protein or HBM protein, respectively. Certain forms of Zmax1 or HBM enhance the activity of endogenous protein, while other forms are inhibitory.

In a preferred embodiment, the HBM protein is used to treat osteoporosis, fracture, or other bone disorder. In a further preferred embodiment, the extracellular portion of HBM or fragment thereof (e.g., the Dkk binding domain) protein is used. This HBM protein may be optionally modified by the addition of a moiety that causes the protein to adhere to the surface of cells. The protein is prepared in a pharmaceutically acceptable solution and is administered by injection or another method that achieves acceptable pharmacokinetics and distribution.

In a second embodiment of this method, Zmax1, HBM, HBM variant, and/or LRP6 levels are increased or decreased by gene therapy techniques. To increase Zmax1 or HBM levels, osteoblasts or another useful cell type are genetically engineered to express high levels of Zmax1 or HBM as described above. Alternatively, to decrease Zmax1 or HBM levels, antisense constructs that specifically reduce the level of translatable Zmax1 or HBM mRNA can be used. In general, a tissue-nonspecific promoter may be used, such as the CMV promoter or another commercially available promoter found in expression vectors (Wu et al., 1996 *Toxicol. Appl. Pharmacol.* 141: 330-9). In a preferred embodiment, a Zmax1 cDNA or its antisense is transcribed by a bone-specific promoter, such as the osteocalcin or another promoter, to achieve specific expression in bone tissue. In this way, if a Zmax1-expressing DNA construct or HBM-expressing construct is introduced into non-bone tissue, it will not be expressed.

In a third embodiment of this method, antibodies against Zmax1, LRP6, HBM-like or HBM are used to modulate its function. Such antibodies are identified herein.

In a fourth embodiment of this method, drugs that are agonists or antagonists of Zmax1 function or HBM function are used. Such drugs are described herein and optimized according to techniques of medicinal chemistry well known to one skilled in the art of pharmaceutical development.

Zmax1 and HBM interact with several proteins, such as ApoE. Molecules that inhibit the interaction between Zmax1 or HBM and ApoE or another binding partner are expected to alter bone development and mineralization. Such inhibitors may be useful as drugs in the treatment of osteoporosis, osteopetrosis, or other diseases of bone mineralization. Such inhibitors may be low molecular weight compounds, proteins or other types of molecules. See, Kim et al., 1998 *J. Biochem.* (Tokyo) 124: 1072-1076.

Inhibitors of the interaction between Zmax1 or HBM and interacting proteins may be isolated by standard drug-screening techniques. For example, Zmax1 protein, (or a fragment thereof) or HBM protein (or a fragment thereof) can be immobilized on a solid support such as the base of microtiter well. A second protein or protein fragment, such as ApoE is derivatized to aid in detection, for example with fluorescein. Iodine, or biotin, then added to the Zmax1 or HBM in the presence of candidate compounds that may specifically inhibit this protein-protein domain of Zmax1 or HBM, respectively, and thus avoid problems associated with its transmembrane segment. Drug screens of this type are well known to one skilled in the art of pharmaceutical development.

Because Zmax1 and HBM are involved in bone development, proteins that bind to Zmax1 and HBM are also expected to be involved in bone development. Such binding proteins can be identified by standard methods, such as co-immunoprecipitation, co-fractionation, or the two-hybrid screen (Ausubel et al., *Current Protocols in Molecular Biology*, John Wiley & Sons (1997)). For example, to identify Zmax1-interacting proteins or HBM-interacting proteins using the two-hybrid system, the extracellular domain of Zmax1 or HBM is fused to LexA and expressed for the yeast vector pEG202 (the "bait") and expressed in the yeast strain EGY48. The yeast strain is transformed with a "prey" library in the appropriate vector, which encodes a galactose-inducible transcription-activation sequence fused to candidate interacting proteins. The techniques for initially selecting and subsequently verifying interacting proteins by this method are well known to one skilled in the art of molecular biology (Ausubel et al., 1997).

In a preferred embodiment, proteins that interact with HBM, but not Zmax1, are identified using a variation of the above procedure (Xu et al., 1997 *Proc. Natl. Acad. Sci. USA*, 94: 12473-8). This variation of the two-hybrid system uses two baits, and Zmax1 and HBM are each fused to LexA and TetR, respectively. Alternatively, proteins that interact with the HBM but not Zmax1 are also isolated. These procedures are well known to one skilled in the art of molecular biology, and are a simple variation of standard two-hybrid procedures.

As an alternative method of isolating substances interacting with Zmax1 or HBM, a biochemical approach is used. The Zmax1 protein or a fragment thereof, such as the extracellular domain, or the HBM protein or a fragment thereof, such as the extracellular domain, is chemically coupled to Sepharose beads. The Zmax1- or HBM-coupled beads are poured into a column. A biological extract, such as a lipid fraction, serum proteins, proteins in the supernatant of a bone biopsy, or cellular contents from gently lysed osteoblast cells, is added to the column. Non-specifically bound compounds are eluted, the column is washed several times with a low-salt buffer, and then tightly binding compounds may be eluted with a high-salt buffer. These are candidate compounds that bind to Zmax1 or HBM, and can be tested for specific binding by standard tests and control experiments. Sepharose beads used for coupling proteins and the methods for performing the coupling are commercially available (Sigma), and the procedures described here are well known to one skilled in the art of protein biochemistry.

As a variation of the above procedure, proteins that are eluted by high salt from the Zmax1- or HBM-sepharose column are then added to an HBM-Zmax1-sepharose column. Proteins that flow through without sticking are proteins that bind to Zmax1 but not to HBM. Alternatively, proteins that bind to the HBM protein and not to the Zmax1 protein can be isolated by reversing the order in which the columns are used.

Isolated compounds may be identified by standard methods such as 2D gel electrophoresis, chromatography, and mass spectroscopy.

24. Method of Use: Transformation-Associated Recombination (TAR) Cloning

Essential for the identification of novel allelic variants of Zmax1 (LRP5) and LRP6 is the ability to examine the sequence of both copies of the gene in an individual. To accomplish this, two "hooks," or regions of significant similarity, are identified within the genomic sequence such that they flank the portion of DNA that is to be cloned. Most preferably, the first of these hooks is derived from sequences 5' to the first exon of interest and the second is derived from sequences 3' to the last exon of interest. These two "hooks" are-cloned into a bacterial/yeast shuttle vector such as that described by Larionov et al., 1997 *Proc. Natl. Acad. Sci. USA,* 94: 7384-7. Other similar vector systems may also be used. To recover the entire genomic copy of the Zmax1 gene, the plasmid containing the two "hooks" is linearized with a restriction endonuclease or is produced-by another method such as PCR. This linear DNA fragment is introduced into yeast cells along with human genomic DNA. Typically, the yeast *Saccharomyces cerevisiae* is used as a host cell, although Kourina et al., 1998 *Genome Res.* 8: 666-72 have reported using chicken host cells as well. During and after the process of transformation, the endogenous host cell converts the linear plasmid to a circle by a recombination event whereby the region of the human genomic DNA homologous to the "hooks" is inserted into the plasmid. This plasmid can be recovered and analyzed by methods well known to one skilled in the art. Obviously, the specificity for this reaction requires the host cell machinery to recognize sequences similar to the "hooks" present in the linear fragment. However, 100% sequence identity is not required, as shown by Kouprina et al., 1998 *Genomics* 53: 21-8, where the author describes using degenerate repeated sequences common in the human genome to recover fragments of human DNA from a rodent/human hybrid cell line.

In another example, only one "hook" is required, as described by Larionov et al., 1998 *Proc. Natl Acad Sci. USA,* 95: 4469-74. For this type of experiment, termed "radial TAR cloning," the other region of sequence similarity to drive the recombination is derived from a repeated sequence from the genome; In this way, regions of DNA adjacent to the Zmax1 gene coding region can be recovered and examined for alterations that may affect function.

25. Methods of Use: Genomic Screening

The use of polymorphic genetic markers linked to the HBM gene, or to Zmax1 (LRP5) or to LRP6 is very useful in predicting susceptibility to osteoporosis or other bone diseases. Koller et al., 1998 *Amer. J. Bone Min. Res.* 13: 1903-8 have demonstrated that the use of polymorphic genetic markers is useful for linkage analysis. Similarly, the identification of polymorphic genetic markers within the high bone mass gene will allow the identification of specific allelic variants that are in linkage disequilibrium with other genetic lesions that affect bone development. Using the DNA sequence from the BACs, a dinucleotide CAn repeat was identified and two unique PCR primers that will amplify the genomic DNA containing this repeat were designed, as shown below:

```
B200E21C16_L: GAGAGGCTATATCCCTGGGC  (SEQ ID NO:38)
B200E21C16_R: ACAGCACGTGTTTAAAGGGG  (SEQ ID NO:39)
``` and used in the genetic mapping study.

This method has been used successfully by others skilled in the art (e.g., Sheffield et al., 1995 *Genet.,* 4:1837-44, LeBlanc-Straceski et al., 1994 *Genomics,* 19: 341-9; Chen et al., 1995 *Genomics,* 25:1-8). Use of these reagents with populations or individuals will predict their risk for osteoporosis. Similarly, single nucleotide polymorphisms (SNPs), such as those shown in Table 4 above, can be used as well to predict risk for developing bone diseases or resistance to osteoporosis in the case of the HBM gene.

26. Methods of Use: Modulators of Tissue Calcification

The calcification of tissues in the human body is well documented. Towler et al. (1998 *J. Biol. Chem.* 273: 30427-34) demonstrated that several proteins known to regulate calcification of the developing skull in a model system are expressed in calcified aorta. The expression of Msx2, a gene transcribed in osteoprogenitor cells, in calcified vascular tissue indicates that genes which are important in bone development are involved in calcification of other tissues.

Treatment with HBM protein, HBM-like proteins and polypeptides, agonists of LRP5 and LRP6 and HBM or antagonists of Dkk-1 are likely to ameliorate calcification (such as the vasculature, dentin and bone of the skull viscera) due to its demonstrated effect on bone mineral density. In experimental systems where tissue calcification is demonstrated, the over-expression or repression of Zmax1 (LRP5) activity permits the identification of molecules that are directly regulated by the Zmax1 gene. These genes are potential targets for therapeutics aimed at modulating tissue calcification. For example, an animal, such as the LDLR −/−, mouse is fed a high fat diet and is observed to demonstrate expression of markers of tissue calcification, including Zmax1. These animals are then treated with antibodies to Zmax1 or HBM protein, antisense oligonucleotides directed against Zmax1 or HBM cDNA, or with compounds known to bind the Zmax1 or HBM protein or its binding partner or ligand. RNA or proteins are extracted from the vascular tissue and the relative expression levels of the genes expressed in the tissue are determined by methods well known in the art. Genes that are regulated in the tissue are potential therapeutic targets for pharmaceutical development as modulators of tissue calcification.

The nucleic acids, proteins, peptides, amino acids, small molecules or other pharmaceutically useful compounds of the present invention that are to be given to an individual may be administered in the form of a composition with a pharmaceutically acceptable carrier, excipient or diluent, which are well known in the art. The individual may be a mammal or a bird, preferably a human, a rat, a mouse or bird. Such compositions may be administered to an individual in a pharmaceutically effective amount. The amount administered will vary depending on the condition being treated and the patient being treated. The compositions may be administered alone or in combination with other treatments.

27. Methods to Identify Agents that Modulate the Expression of a Nucleic Acid Encoding the Dkk and/or CORP5 Proteins and/or Dkk Interacting Proteins Another embodiment of the present invention provides methods for identifying agents that modulate the expression of a nucleic acid encoding Dkk, which is part of the Wnt pathway and that interacts with LRP5, LRP6 and to much lesser extent to HBM and its variants. Such assays may utilize any available means of monitoring for changes in the expression level of the nucleic acids of the invention. As used herein, an agent is said to modulate the expression of Dkk, if it is capable of up- or down-regulating expression of the nucleic acid in a cell (e.g., mRNA).

In one assay format, cell lines that contain reporter gene fusions between the nucleic acid encoding Dkk (or proteins which modulate the activity of Dkk) and any assayable fusion partner may be prepared. Numerous assayable fusion partners are known and readily available, including but not limited to the firefly luciferase gene and the gene encoding chloramphenicol acetyltransferase (Alam et al., 1990 *Anal. Biochem.* 188: 245-54). Cell lines containing the reporter gene fusions are then exposed to the agent to be tested under appropriate conditions and time. Differential expression of the reporter gene between samples exposed to the agent and control samples identifies agents which modulate the expression of a nucleic acid encoding Dkk or other protein which modulates Dkk activity. Such assays can similarly be used to determine whether LRP5 and even LRP6 activity is modulated by regulating Dkk activity. This can also be performed with the HBM variants.

Additional assay formats may be used to monitor the ability of the agent(s) to modulate the expression of a nucleic acid encoding Dkk, alone or Dkk and LRP5, and/or Dkk interacting proteins such as those identified in FIG. 31. For instance, mRNA expression may be monitored directly by hybridization to the nucleic acids of the invention. Cell lines are exposed to the agent to be tested under appropriate conditions and time and total RNA or mRNA is isolated by standard procedures such those disclosed in Sambrook et al. (1989); Ausubel et al., *Current Protocols in Molecular Biology* (Greene Publishing Co., NY, 1995); Maniatis et al., *Molecular Cloning: A Laboratory Manual* (Cold Spring Harbor Laboratory, Cold Spring Harbor, N.Y., 1982); and *Short Protocols in Molecular Biology: A Compendium of Methods from Current Protocols in Molecular Biology* (Frederick M. Ausubel et al., April 1999).

Probes to detect differences in RNA expression levels between cells exposed to the agent and control cells may be prepared from the nucleic acids of the invention. It is preferable, but not necessary, to design probes which hybridize only with target nucleic acids under conditions of high stringency. Only highly complementary nucleic acid hybrids form under conditions of high stringency. Accordingly, the stringency of the assay conditions determines the amount of complementarity which should exist between two nucleic acid strands in order to form a hybrid. Stringency should be chosen to maximize the difference in stability between the probe:target hybrid and potential probe:non-target hybrids.

Probes may be designed from the nucleic acids of the invention through methods known in the art. For instance, the G+C content of the probe and the probe length can affect probe binding to its target sequence. Methods to optimize probe specificity are commonly available. See for example, Sambrook et al. (1989) or Ausubel et al. (*Current Protocols in Molecular Biology*, Greene Publishing Co., NY, 1995).

Hybridization conditions are modified using known methods, such as those described by Sambrook et al. (1989) and Ausubel et al. (1995), as suitable for each probe. Hybridization of total cellular RNA or RNA enriched for polyA RNA can be accomplished in any available format. For instance, total cellular RNA or RNA enriched for polyA RNA can be affixed to a solid support and the solid support exposed to at least one probe comprising at least one, or part of one of the nucleic acid sequences of the invention under conditions in which the probe will specifically hybridize. Alternatively, nucleic acid fragments comprising at least one, or part of one of the sequences of the invention can be affixed to a solid support, such as a porous glass wafer. The glass or silica wafer can then be exposed to total cellular RNA or polyA RNA from a sample under conditions in which the affixed sequences will specifically hybridize. Such glass wafers and hybridization methods are widely available, for example, those disclosed by Beattie (WO 95/11755). By examining for the ability of a given probe to specifically hybridize to an RNA sample from an untreated cell population and from a cell population exposed to the agent, agents which up- or down-regulate the expression of a nucleic acid encoding Dkk, a Dkk interacting protein, and/or LRP5 can be identified.

Microarray technology and transcriptional profiling are examples of methods which can be used to analyze the impact of putative Dkk or Dkk interacting protein modulating compounds. For transcriptional profiling, mRNA from cells exposed in vivo to a potential Dkk modulating agent, such as the Dkk interacting proteins identified in the present invention (e.g., those identified in FIG. 31), agents which modulate Dkk interacting proteins, and mRNA from the same type of cells that were not exposed to the agent could be reverse transcribed and hybridized to a chip containing DNA from numerous genes, to thereby compare the expression of genes in cells treated and not treated with the agent. If, for example a putative Dkk modulating agent down-regulates the expression of Dkk in the cells, then use of the agent may be undesirable in certain patient populations. For additional methods of transcriptional profiling and the use of microarrays, refer to, for example, U.S. Pat. No. 6,124,120 issued to Lizardi (2000).

Additional methods for screening the impact of Dkk and Dkk interacting protein modulating compounds or the impact of Dkk or Dkk interacting proteins on modulation of LRP5, LRP6, HBM, HBM variants or the Wnt pathway include the use of TaqMan® PCR, conventional reverse transcriptase PCR (RT-PCR), changes in downstream surrogate markers (i.e., Wnt responsive genes), and anti-Dkk Western blots for protein detection. Other methods would be readily apparent to the artisan of ordinary skill.

28. Methods to Identify Agents that Modulate at Least One Activity of Dkk, a Dkk Interacting Protein, or LRP5/LRP6/HBM/HBM-like Another embodiment of the present invention provides methods for identifying agents that modulate at least one activity of Dkk, Dkk interacting proteins, and/or LRP5/LRP6/HBM/HBM-like proteins or preferably which specifically modulate an activity of a Dkk/Dkk interacting protein complex or an LRP5 (or LRP6/HBM/HBM-like)/Dkk complex, or a biologically active fragment of Dkk (e.g., comprising the domain which binds LRP5/LRP6/HBM/HBM-like) or a Dkk interacting protein complex. Such methods or assays may utilize any means of monitoring or detecting the desired activity as would be known in the art (See, e.g., Wu et al., 2000 *Curr. Biol.* 10:1611-4; Fedi et al., 199 *J. Biol. Chem.* 274: 19465-72; Grotewold et al., 1999 *Mech. Dev.* 89:151-3; Shibata et al., 2000 *Mech. Dev.* 96: 243-6; Wang et al., 2000 *Oncogene* 19: 1843-8; and Glinka et al., 1998 *Nature* 391: 357-62). Potential agents which modulate Dkk include, for example, p53, the tumor suppressor protein, which can induce Dkk-1. Damage to DNA has also been observed to up-regulate Dkk-1 expression via a stabilization and activation of p53 (Wang et al., 2000 *Oncogene* 19: 1843-48); and, Shou et al., 2002 *Oncogene* 21: 878-89). Additionally, Fedi et al. (1999) purportedly showed that Dkk-1 can block the Wnt2-induced oncogenic transformation of NIH-3T3 cells. Furthermore, it has been suggested that Dkk expression may be modulated by BMP signaling in the developing skeleton (Mukhopadhyay et al., 2001 *Dev. Cell.* 1: 423-34; and Grotewold et al., 2002 *EMBO J.* 21: 966-75). Grotewald et al. additionally describe altered Dkk expression levels in response to stress signals including UV irradiation and other genotoxic stimuli. They propose that Dkk expression is pro-apoptotic. In the HBMMTIC animals described herein, a reduced osteoblast apoptosis effect was observed. Thus, HBM and HBM like variants may control/alter Dkk's role in programmed cell death. Other agents which potentially modulate Dkk activity include the Dkk interacting proteins identified in FIG. 31.

In one embodiment, the relative amounts of Dkk or a Dkk interacting protein of a cell population that has been exposed to the agent to be tested is compared to an un-exposed control cell population. Antibodies can be used to monitor the differential expression of the protein in the different cell populations. Cell lines or populations are exposed to the agent to be tested under appropriate conditions and time. Cellular lysates may be prepared from the exposed cell line or population and a control, unexposed cell line or population. The cellular lysates are then analyzed with the probe, as would be known in the art. See, e.g., Ed Harlow and David Lane, *Antibodies: A Laboratory Manual* (Cold Spring Harbor, N.Y., 1988) and Ed Harlow and David Lane, *Using Antibodies: A Laboratory Manual* (Cold Spring Harbor, N.Y. 1998).

For example, N- and C- terminal fragments of Dkk can be expressed in bacteria and used to search for proteins which bind to these fragments. Fusion proteins, such as His-tag or GST fusion to the N- or C-terminal regions of Dkk (or to biologically active domains of Dkk-1) or a whole Dkk protein can be prepared. These fusion proteins can be coupled to, for example, Talon or Glutathione-Sepharose beads and then probed with cell lysates to identify molecules which bind to Dkk. Prior to lysis, the cells may be treated with purified Wnt proteins, RNA, or drugs which may modulate Wnt signaling or proteins that interact with downstream elements of the Wnt pathway. Lysate proteins binding to the fusion proteins can be resolved by SDS-PAGE, isolated and identified by, for example protein sequencing or mass spectroscopy, as is known in the art. See, e.g., *Protein Purification Applications: A Practical Approach* (Simon Roe, ed., $2^{nd}$ ed. Oxford Univ. Press, 2001) and "Guide to Protein Purification" in *Meth. Enzymology* vol. 182 (Academic Press, 1997).

The activity of Dkk, a Dkk interacting protein, or a complex of Dkk with LRP5/LRP6/HBM/HBM-like may be affected by compounds which modulate the interaction between Dkk and a Dkk interacting protein (such as those shown in FIG. 31) and/or Dkk and LRP5/LRP6/HBM/HBM-like. The present invention provides methods and research tools for the discovery and characterization of these compounds. The interaction between Dkk and a Dkk interacting protein and/or Dkk and LRP5/6/HBM/HBM-like may be monitored in vivo and in vitro. Compounds which modulate the stability of a Dkk-LRP5/LRP6/HBM/HBM-like complex are potential therapeutic compounds. Example in vitro methods include: Binding LRP5/6/HBM/HBM-like, Dkk, or a Dkk interacting protein to a sensor chip designed for an instrument such are made by Biacore (Uppsala, Sweden) for the performance of an plasmon resonance spectroscopy observation. In this method, the chip with one of Dkk, a Dkk interacting protein, or LRP5/6 is first exposed to the other under conditions which permit them to form the complex. A test compound is then introduced and the output signal of the instrument provides an indication of any effect exerted by the test compound. By this method, compounds may be rapidly screened. Another, in vitro, method is exemplified by the SAR-by-NMR methods (Shuker et al., *Science.* 274:1531-4 (1996)). Briefly, a Dkk-1 binding domain and/or LRP 5 or 6 LBD are expressed and purified as $^{15}N$ labeled protein by expression in labeled media. The labeled protein(s) are allowed to form the complex in solution in an NMR sample tube. The heteronuclear correlation spectrum in the presence and absence of a test compound provides data at the level of individual residues with regard to interactions with the test compound and changes at the protein-protein interface of the complex. One of skill in the art knows of many other protocols, e.g. affinity capillary electrophoresis (Okun et al., 2001 *J. Biol. Chem.* 276: 1057-62; Vergnon et al., 1999 *Methods,* 19: 270-7), fluorescence spectroscopy, electron paramagnetic resonance, etc. which can monitor the modulation of a complex and/or measure binding affinities for complex formation.

In vitro protocols for monitoring the modulation of a Dkk/LRP5/LRP6/HBM/HBM-like complex include the yeast two hybrid protocol. The yeast two hybrid method may be used to monitor the modulation of a complex in vivo by monitoring the expression of genes activated by the formation of a complex of fusion proteins of Dkk and LRP ligand binding domains. Nucleic acids according to the invention which encode the interacting Dkk and LRP LBD domains are incorporated into bait and prey plasmids. The Y2H protocol is performed in the presence of one or more test compounds. The modulation of the complex is observed by a change in expression of the complex activated gene. It will be appreciated by one skilled in the art that test compounds can be added to the assay directly or, in the case of proteins, can be coexpressed in the yeast with the bait and prey compounds. Similarly, fusion proteins of Dkk and Dkk interacting proteins can also be used in a Y2H screen to identify other proteins which modulate the Dkk/Dkk interacting protein complex.

Assay protocols such as these may be used in methods to screen for compounds, drugs, treatments which modulate the Dkk/Dkk interacting protein and/or Dkk/LRP5/6 complex, whether such modulation occurs by competitive binding, or by altering the structure of either LRP 5/6 or Dkk at the binding site, or by stabilizing or destablizing the protein-protein interface. It may be anticipated that peptide aptamers may competitively bind, although induction of an altered binding site structure by steric effects is also possible.

28.1 Antibodies and Antibody Fragments

Polyclonal and monoclonal antibodies and fragments of these antibodies which bind to Dkk or LRP5/LRP6/HBM/HBM-like can be prepared as would be known in the art. For example, suitable host animals can be immunized using appropriate immunization protocols and the peptides, polypeptides or proteins of the invention. Peptides for use in immunization are typically about 8-40 residues long. If necessary or desired, the polypeptide immunogens can be conjugated to suitable carriers. Methods for preparing immunogenic conjugates with carriers such as bovine serum albumin (BSA), keyhole limpet hemocyanin (KLH), or other carrier proteins are well known in the art (See, Harlow et al., 1988). In some circumstances, direct conjugation using, for example, carbodiimide reagents, may be effective; in other instances linking reagents such as those supplied by Pierce Chemical Co., Rockford, Ill., may be desirable to provide accessibility to the polypeptide or hapten. The hapten peptides can be extended at either the amino or carboxy terminus with a cysteine residue or interspersed with cysteine residues, for example, to facilitate linking to a carrier. Administration of the immunogens is conducted generally by injection over a suitable time period and with use of suitable adjuvants, as is generally understood in the art. During the immunization schedule, titers of antibodies are taken to determine adequacy of antibody formation.

Anti-peptide antibodies can be generated using synthetic peptides, for example, the peptides derived from the sequence of any Dkk, including Dkk-1, or LRP5/LRP6/HBM/HBM-like. Synthetic peptides can be as small as 2-3 amino acids in length, but are preferably at least 3, 5, 10, or 15 or more amino acid residues long. Such peptides can be determined using programs such as. DNAStar. The peptides are coupled to KLH using standard methods and can be immunized into animals such as rabbits. Polyclonal anti-Dkk or anti-LRP5/LRP6/HBM/HBM-like peptide antibodies can then be purified, for example using Actigel beads containing the covalently bound peptide.

While the polyclonal antisera produced in this way may be satisfactory for some applications, for pharmaceutical compositions, use of monoclonal preparations is preferred. Immortalized cell lines which secrete the desired monoclonal antibodies may be prepared using the standard method of Kohler and Milstein or modifications which effect immortalization of lymphocytes or spleen cells, as is generally known (See, e.g., Harlow et al., 1988 and 1998). The immortalized cell lines secreting the desired antibodies can be screened by immunoassay in which the antigen is the peptide hapten, polypeptide or protein. When the appropriate immortalized cell culture secreting the desired antibody is identified, the cells can be cultured either in vitro or by production in ascites fluid.

The desired monoclonal antibodies are then recovered from the culture supernatant or from the ascites supernatant. Fragments of the monoclonal antibodies which contain the immunologically significant portion can be used as agonists or antagonists of Dkk activity. Use of immunologically reactive fragments, such as the Fab, scFV, Fab', of $F(ab')_2$ fragments are often preferable, especially in a therapeutic context, as these fragments are generally less immunogenic than the whole immunoglobulin.

The antibodies or fragments may also be produced, using current technology, by recombinant means. Regions that bind specifically to the desired regions of Dkk or LRP5/LRP6/HBM/HBM-like can also be produced in the context of chimeras with multiple species origin. Antibody reagents so created are contemplated for use diagnostically or as stimulants or inhibitors of Dkk activity.

In one embodiment, antibodies against Dkk, bind Dkk with high affinity, i.e., ranging from $10^{-5}$ to $10^{-9}$ M. Preferably, the anti-Dkk antibody will comprise a chimeric, primate, Primatized®, human or humanized antibody. Also, the invention embraces the use of antibody fragments, e.g., Fab's, Fv's, Fab's, $F(ab)_2$, and aggregates thereof.

Another embodiment contemplates chimeric antibodies which recognize Dkk or LRP5/LRP6/HBM/HBM-like. A chimeric antibody is intended to refer to an antibody with non-human variable regions and human constant regions, most typically rodent variable regions and human constant regions.

A "primatized® antibody" refers to an antibody with primate variable regions, e.g., CDR's, and human constant regions. Preferably, such primate variable regions are derived from an Old World monkey.

A "humanized antibody" refers to an antibody with substantially human framework and constant regions, and non-human complementarity-determining regions (CDRs). "Substantially" refers to the fact that humanized antibodies typically retain at least several donor framework residues (i.e., of non-human parent antibody from which CDRs are derived).

Methods for producing chimeric, primate, primatized®, humanized and human antibodies are well known in the art. See, e.g., U.S. Pat. No. 5,530,101, issued to Queen et al.; U.S. Pat. No. 5,225,539, issued to Winter et al.; U.S. Pat. Nos. 4,816,397 and 4,816,567, issued to Boss et al. and Cabilly et al. respectively, all of which are incorporated by reference in their entirety.

The selection of human constant regions may be significant to the therapeutic efficacy of the subject anti-Dkk or LRP5/LRP6/HBM/HBM-like antibody. In a preferred embodiment, the subject anti-Dkk or LRP5/LRP6/HBM/HBM-like antibody will comprise human, gamma 1, or gamma 3 constant regions and, more preferably, human gamma 1 constant regions.

Methods for making human antibodies are also known and include, by way of example, production in SCID mice, and in vitro immunization.

The subject anti-Dkk or LRP5/LRP6/HBM/HBM-like antibodies can be administered by various routes of administration, typically parenteral. This is intended to include intravenous, intramuscular, subcutaneous, rectal, vaginal, and administration with intravenous infusion being preferred.

The anti-Dkk or LRP5/LRP6/HBM/HBM-like antibody will be formulated for therapeutic usage by standard methods, e.g., by addition of pharmaceutically acceptable buffers, e.g., sterile saline, sterile buffered water, propylene glycol, and combinations thereof.

Effective dosages will depend on the specific antibody, condition of the patient, age, weight, or any other treatments, among other factors. Typically effective dosages will range from about 0.001 to about 30 mg/kg body weight, more preferably from about 0.01 to 25 mg/kg body weight, and most preferably from about 0.1 to about 20 mg/kg body weight.

Such administration may be effected by various protocols, e.g., weekly, bi-weekly, or monthly, depending on the dosage administered and patient, response. Also, it may be desirable to combine such administration with other treatments.

Antibodies to Dkk-1 interacting proteins, such as those identified in FIG. 31, are also contemplated according to the present invention, and can be used similarly to the Dkk-1 antibodies mentioned in the above methodology.

The antibodies of the present invention can be utilized in experimental screening, as diagnostic reagents, and in therapeutic compositions.

28.2 Chemical Libraries

Agents that are assayed by these methods can be randomly selected or rationally selected or designed. As used herein, an agent is said to be randomly selected when the agent is chosen randomly without considering the specific sequences involved in the association of Dkk-1 alone, Dkk-1 interacting proteins alone, or with their associated substrates, binding partners, etc. An example of randomly selected agents is the use of a chemical library or a peptide combinatorial library, or a growth broth of an organism.

The agents of the present invention can be, as examples, peptides, small molecules, vitamin derivatives, as well as carbohydrates. A skilled artisan can readily recognize that there is no limit as to the structural nature of the agents of the present invention.

28.3 Peptide Synthesis

The peptide agents of the invention can be prepared using standard solid phase (or solution phase) peptide synthesis methods, as is known in the art. In addition, the DNA encoding these peptides may be synthesized using commercially available oligonucleotide. synthesis instrumentation and produced recombinantly using standard recombinant production systems. The production of polypeptides using solid phase peptide synthesis is necessitated if non-nucleic acid-encoded amino acids are to be included.

29. Uses for Agents that Modulate at Least One Activity of Dkk, a Dkk Interacting Protein, a Dkk/Dkk Interacting Protein Complex, or a Dkk/LRP5 or Dkk/LRP6 Complex The proteins and nucleic acids of the invention, such as the proteins or polypeptides containing an amino acid sequence of LRP5, Disk, and Dkk interacting proteins are involved in bone mass modulation and lipid modulation of other Wnt pathway mediated activity. Agents that modulate (i.e., up and down-regulate) the expression of Dkk or Dkk interacting proteins, or agents, such as agonists and antagonists respectively, of at least one activity of Dkk or a Dkk interacting protein may be used to modulate biological and pathologic processes associated with the function and activity of Dkk or a Dkk interacting protein.

As used herein, a subject can be preferably any mammal, so long as the mammal is in need of modulation of a pathological or biological process modulated by a protein of the invention. The term "mammal" means an individual belonging to the class Mammalia. The invention is particularly useful in the treatment of human subjects.

As used herein, a biological or pathological process modulated by Dkk or a Dkk interacting protein may include binding of Dkk to a Dkk interacting protein, Dkk to LRP5 or LRP6 or release therefrom, inhibiting or activating Dkk or a Dkk interacting protein mRNA synthesis or inhibiting Dkk or Dkk interacting protein modulated inhibition of LRP5 or LRP6 mediated Wnt signaling. Further bone-related markers may be observed such as alkaline phosphatase activity, osteocalcin production, or mineralization.

Pathological processes refer to a category of biological processes which produce a deleterious effect. For example, expression or up-regulation of expression of LRP5 or LRP6 and/or Dkk and/or a Dkk interacting protein may be associated with certain diseases or pathological conditions. As used herein, an agent is said to modulate a pathological process when the agent statistically significantly ($p<0.05$) alters the process from its base level in the subject. For example, the agent may reduce the degree or severity of the process mediated by that protein in the subject to which the agent was administered. For instance, a disease or pathological condition may be prevented, or disease progression modulated by the administration of agents which reduce or modulate in some way the expression or at least one activity of a protein of the invention.

As LRP5/6 and Dkk are involved both directly and indirectly in bone mass modulation, one embodiment of this invention is to use Dkk or Dkk interacting protein expression as a method of diagnosing a bone condition or disease. Certain markers are associated with specific Wnt signaling conditions (e.g., TCF/LEF activation). Diagnostic tests for bone conditions may include the steps of testing a sample or an extract thereof for the presence of Dkk or Dkk interacting protein nucleic acids (i.e., DNA or RNA), oligomers or fragments thereof or protein products of TCF/LEF regulated expression. For example, standard in situ hybridization or other imaging techniques can be utilized to observe products of Wnt signaling. Other diagnostic techniques, as described herein, would also be useful as would be apparent to the skilled artisan (e.g., a serum marker).

This invention also relates to methods of modulating bone development or bone loss conditions. Inhibition of bone loss may be achieved by inhibiting or modulating changes in the LRP5/6 mediated Wnt signaling pathway. For example, absence of LRP5 activity may be associated with low bone mass. Increased activity LRP5 may be associated with high bone mass. Therefore, modulation of LRP5 activity will in turn modulate bone development. Modulation of the Dkk/LRP5/6 or Dkk/Dkk interacting protein complex via agonists and antagonists is one embodiment of a method to regulate bone development. Such modulation of bone development can result from inhibition of the activity of, for example, a Dkk/LRP(5/6) protein complex, a Dkk/Dkk interacting protein complex, upregulated transcription of the LRP5 gene or inhibited transcription or translation of Dkk or Dkk interacting protein mRNA.

The agents of the present invention can be provided alone, or in combination with other agents that modulate a particular pathological process. As used herein, two agents are said to be administered in combination when the two agents are administered simultaneously or are administered independently in a fashion such that the agents will act at the same time.

The agents of the present invention can be administered via parenteral, subcutaneous (sc), intravenous (iv), intramuscular (im), intraperitoneal (ip), transdermal or buccal routes. Alternatively, or concurrently, administration may be by the oral route. The dosage administered will be dependent upon the age, health, and weight of the recipient, kind of concurrent treatment, if any, frequency of treatment, and the nature of the effect desired.

The present invention further provides compositions containing one or mi ore agents which modulate expression or at least one activity of a protein of the invention. While individual needs vary, determination of optimal ranges of effective amounts of each component is within the skill of the art. Typical dosages of the active agent which mediate Dkk or Dkk interacting protein activity comprise from about 0.0001 to about 50 mg/kg body weight. The preferred dosages comprise from about 0.001 to about 50 mg/kg body weight. The most preferred dosages comprise from about 0.1 to about 1 mg/kg body weight. In an average human of 70 kg, the range would be from about 7 µg to about 3.5 g, with a preferred range of about 0.5 mg to about 5 mg.

In addition to the pharmacologically active agent, the compositions of the present invention may contain suitable pharmaceutically acceptable carriers comprising excipients and auxiliaries which facilitate processing of the active compounds into preparations which can be used pharmaceutically for delivery to the site of action. Suitable formulations for parenteral administration include aqueous solutions of the active compounds in water-soluble form, for example, water-soluble salts. In addition, suspensions of the active compounds as appropriate oily injection suspensions may be administered. Suitable lipophilic solvents or vehicles include fatty oils, for example, sesame oil, or synthetic fatty acid esters, (e.g., ethyl oleate or triglycerides). Aqueous injection suspensions may contain substances which increase the viscosity of the suspension include, for example, sodium carboxymethyl cellulose, sorbitol and/or dextran. Optionally, the suspension may also contain stabilizers. Liposomes and other non-viral vectors can also be used to encapsulate the agent for delivery into the cell.

The pharmaceutical formulation for systemic administration according to the invention may be formulated for enteral, parenteral, or topical (top) administration. Indeed, all three types of formulations may be used simultaneously to achieve systemic administration of the active ingredient.

Suitable formulations for oral administration include hard or soft gelatin capsules, pills, tablets, including coated tablets, elixirs, suspensions, syrups or inhalations and controlled release forms thereof.

Potentially, any compound which binds Dkk or a Dkk interacting protein or modulates the Dkk/LRP5 or Dkk/LRP6 or Dkk/Dkk interacting protein complex may be a therapeutic compound. In one embodiment of the invention, a peptide or nucleic acid aptamer according to the invention is used in a therapeutic composition. Such compositions may comprise an aptamer, or a LRP5 or LRP6 fragment unmodified or modified. In another embodiment, the therapeutic compound comprises a Dkk-1 interacting protein, or biologically active fragment thereof.

Nucleic acid aptamers have been used in compositions for example by chemical bonding to a carrier molecule such as polyethylene glycol (PEG) which may facilitate uptake or stabilize the aptamer. A di-alkylgylcerol moiety attached to an RNA will embed the aptamer in liposomes, thus stabilizing the compound. Incorporating chemical substitutions (i.e. changing the 2'OH group of ribose to a 2'NH in RNA confers ribonuclease resistance) and capping, etc. can prevent breakdown. Several such techniques are discussed for RNA aptamers in Brody and Gold (*Rev. Mol. Biol.* 74:3-13, 2000).

Peptide aptamers may by used in therapeutic applications by the introduction of an expression vector directing aptamer expression into the affected tissue such as for example by retroviral delivery, by encapsulating the DNA in a delivery complex or simple by naked DNA injection. Or, the aptamer itself or a synthetic analog may be used directly as a drug. Encapsulation in polymers and lipids may assist in delivery. The use of peptide aptamers as therapeutic and diagnostic agents is reviewed by Hoppe-Syler and Butz (*J. Mol. Med.* 78:426-430 (2000)).

In another aspect of the invention. The structure of a constrained peptide aptamer of the invention may be determined such as by NMR or X-ray crystallography. (Cavanagh et al., *Protein NMR Spectroscopy Principles and Practice*, Academic Press, 1996; Drenth, *Principles of Protein X-Ray Crystallography*, Springer Verlag, 1999) Preferably the structure is determined in complex with the target protein. A small molecule analog is then designed according to the positions of functional elements of the 3D structure of the aptamer. (*Guidebook on Molecular Modeling in Drug Design*, Cohen, Ed., Academic Press, 1996; *Molecular Modeling and Drug Design* (*Topics in Molecular and Structural Biology*), Vinter and Gardner Eds., CRC Press, 1994) Thus the present invention provides a method for the design of effective and specific drugs which modulate the activity of Dkk, Dkk interacting proteins, Dkk/Dkk interacting protein complex and the Dkk/LRP complex. Small molecule mimetics of the peptide aptamers of the present invention are encompassed within the scope of the invention.

In practicing the methods of this invention, the compounds of this invention may be used alone or in combination, or in combination with other therapeutic or diagnostic agents. In certain preferred embodiments, the compounds of this invention may be co-administered along with other compounds typically prescribed for these conditions according to generally accepted medical practice. For example, the compounds of this invention can be administered in combination with other therapeutic agents for the treatment of bone loss. Bone loss mediating agents include bone resorption inhibitors such as bisphosphonates (e.g., alendronic acid, clodronic acid, etidronic acid, pamidronic acid, risedronic acid and tiludronic acid), vitamin D and vitamin D analogs, cathepsin K inhibitors, hormonal agents (e.g., calcitonin and estrogen), and selective estrogen receptor modulators or SERMs (e.g., raloxifene). And bone forming agents such as parathyroid hormone (PTH) and bone morphogenetic proteins (BMP).

Additionally contemplated are combinations of agents which regulate Dkk-1 and agents which regulate lipid levels such as HMG-CoA reductase inhibitors (i.e., statins such as Mevacor®, Lipitor® and other inhibitors such as Baycol®, Lescol®, Pravachol® and Zocor®), bile acid sequestrants (e.g., Colestid® and Welchol®), fibric acid derivatives (Atromid-S®, Lopid®, Tricor®), and nicotinic acid.

The compounds of this invention can-be utilized in vivo, ordinarily in vertebrates and preferably in mammals, such as humans, sheep, horses, cattle, pigs, dogs, cats, rats and mice, or in vitro.

30. Peptide and Nucleotide Aptamers and Peptide Aptamer Mimetics

Figure 5:
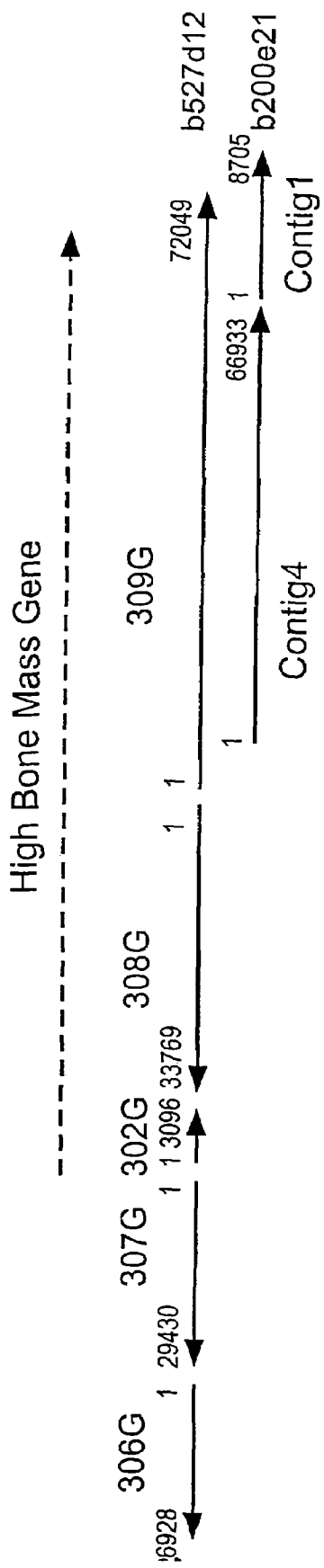
FIG. 5 is a schematic illustration of the BAC contigs B527D12 and B200E21 in relation to the HBM gene.

Another embodiment contemplates the use of peptide and nucleotide aptamer technology to screen for agents which interact with Dkk, which block Dkk from interacting with LRP5, LRP6, HBM, or HBM-like molecules, or which block any other Dkk ligand interaction, or which interact with Dkk interacting proteins, such as those shown in FIG. 5. Peptide aptamers are molecules in which a variable peptide domain is displayed from a scaffold protein. Thioredoxin A (trxA) is commonly used for a scaffold. The peptide insert destroys the catalytic site of trxA. It is recognized that numerous proteins may also be used as scaffolding proteins to constrain and/or present a peptide aptamer. Other scaffold proteins that could display a constrained peptide aptamer could include *staphylococcal* nuclease, the protease inhibitor eglin C, the *Streptomyces tendea* alpha-amylase inhibitor Tendamistat, Sp1, green fluorescent protein (GFP) (reviewed in Hoppe-Seyler et al., 2001 *J. Steroid Biochem Mol. Biol.* 78: 105-11), and the S1 nucleas from *Staphyloccus* or M13 for phage display. Any molecule to which the aptamer could be anchored and presented in its bioactive conformation would be suitable.

Aptamers can then specifically bind to a given target protein in vitro and in vivo and have the potential to selectively block the function of their target protein. Peptide aptamers are selected from randomized expression libraries on the basis of their in vivo binding capacity to the desired target protein. Briefly, a target protein (e.g., Dkk, a Dkk interacting protein, or LRP5/6) is linked to a heterologous DNA binding domain (BD) and expressed as bait in a yeast test strain. Concomitantly, a library coding for different peptides (e.g., 16-mers) of randomized sequence inserted in a scaffold protein sequence, which are linked to a heterologous transcriptional activation domain (AD) is expressed as prey. If a peptide binds to a target protein, a functional transcription factor is reconstituted, in which the BD and AD are bridged together by interacting proteins. This transcription factor is then able to activate the promoter of a marker gene which can be monitored by colorimetric enzymatic assays or by growth selection. Additional variation, methods of preparing and screening methodologies are described in, for example, Hoppe-Seyler et al., 2000 *J. Mol. Med.* 78: 426-430.

Nucleotide aptamers are described for example in Brody et al., 2000 *Trends Mol. Biotechnol.* 74: 5-13. Additional methods of making and using nucleotide aptamers include SELEX, i.e., Systematic Evolution-of Ligands by Exponential Enrichment. SELEX is a process of isolating oligonucleotide ligands of a chosen target molecule (see Tuerk and Gold, *Science* 249:505-510 (1990); U.S. Pat. Nos. 5,475,096, 5,595,877, and 5,660,985). SELEX, as described in Tuerk and Gold, involves admixing the target molecule with a pool of oligonucleotides (e.g., RNA) of diverse sequences; retaining complexes formed between the target and oligonucleotides; recovering the oligonucleotides bound to the target; reverse-transcribing the RNA into DNA; amplifying the DNA with polymerase chain reactions (PCR); transcribing the amplified DNA into RNA; and repeating the cycle with ever increasing binding stringency. Three enzymatic reactions are required for each cycle. It usually takes 12-15 cycles to isolate aptamers of high affinity and specificity to the target. An aptamer is an oligonucleotide that is capable of binding to an intended target substance but not other molecules under the same conditions.

In another reference, Bock et al., 1990 Nature 355: 564-6, describe a different process from the SELEX method of Tuerk and Gold in that only one enzymatic reaction is required for each cycle (i.e., PCR) because the nucleic acid library in Bock's method is comprised of DNA instead of RNA. The identification and isolation of aptamers of high specificity and affinity with the method of Bock et al. still requires repeated cycles in a chromatographic column.

Other nucleotide aptamer methods include those described by Conrad et al, 1996 Meth. Enzymol. 267: 336-367. Conrad et al. describe a variety of methods for isolating aptamers, all of which employ repeated cycles to enrich target-bound ligands and require a large amount of purified target molecules. More recently described methods of making and using nucleotide aptamers include, but are not limited to those described in U.S. Pat. Nos. 6,180,348; 6,051,388; 5,840,867; 5,780,610, 5,756,291 and 5,582,981.

Potentially, any compound which binds Dkk or a Dkk interacting protein or modulates the Dkk/Dkk interacting protein or Dkk/LRP5, Dkk/LRP6, Dkk/HBM, or Dkk/HBM-like complex may be a therapeutic compound. In one embodiment of the invention, a peptide or nucleic acid aptamer according to the invention is used in a therapeutic composition. Such compositions may comprise an aptamer, or a LRP5 or LRP6 fragment unmodified or modified.

Nucleic acid aptamers have been used in compositions for example by chemical bonding to a carrier molecule such as polyethylene glycol (PEG) which may facilitate uptake or stabilize the aptamer. A di-alkylglycerol moiety attached to an RNA will embed the aptamer in liposomes, thus stabilizing the compound. Incorporating chemical substitutions (i.e., changing the 2'-OH group of ribose to a 2'-NH in RNA confers ribonuclease resistance) and capping, etc. can prevent breakdown. Several such techniques' are discussed for RNA aptamers in Brody et al., 2000 Rev. Mol. Biol. 74: 3-13.

Peptide aptamers may by used in therapeutic applications by the introduction of an expression vector directing aptamer expression into the affected tissue such as for example by retroviral delivery, by encapsulating the DNA in a delivery complex or simple by naked DNA injection. Or, the aptamer itself or a synthetic analog may be used directly as a drug. Encapsulation in polymers and lipids may assist in delivery. The use of peptide aptamers as therapeutic and diagnostic agents is reviewed by Hoppe-Syler et al., 2000 *J. Mol. Med* 78: 426-430.

In another aspect of the invention, the structure of a constrained peptide aptamer of the invention may be determined such as by NMR or X-ray crystallography. (Cavanah et al;, *Protein NMR Spectroscopy Principles and Practice*, Academic Press, 1996; Drenth, Principles of Protein X-Ray Crystallography, Springer Verlag, 1999) Preferably the structure is determined in complex with the target protein. A small molecule analog is then designed according to the positions of functional elements of the 3D structure of the aptamer. (*Guidebook on Molecular Modeling in Drug Design*, Cohen, Ed., Academic Press, 1996; *Molecular Modeling and Drug Design* (*Topics in Molecular and Structural Biology*), Vinter and Gardner Eds., CRC Press, 1994) Thus, a method is provided for the design of effective and specific drugs which modulate the activity of Dkk, Dkk interacting proteins, Dkk/Dkk interacting protein complex, and the Dkk/LRP complex. Small molecule mimics of the peptide aptamers of the present invention are also encompassed within the scope of the invention.

EXAMPLES

The present invention is described by reference to the following Examples, which are offered by way of illustration and are not intended to limit the invention in any manner. Standard techniques well known in the art or the techniques specifically described below were utilized.

Example 1

The propositus was referred by her physicians to the Creighton Osteoporosis Center for evaluation of what appeared to be unusually dense bones. She was 18 years old and came to medical attention two years previous because of back pain, which was precipitated by an auto accident in which the car in which she was riding as a passenger was struck from behind. Her only injury was soft tissue injury to her lower back that was manifested by pain and muscle tenderness. There was no evidence of fracture or subluxation on radiographs. The pain lasted for two years, although she was able to attend school full time. By the time she was seen in the Center, the pain was nearly resolved and she was back to her usual activities as a high school student. Physical exam revealed a normal healthy young woman standing 66 inches and weighing 128 pounds. Radiographs of the entire skeleton revealed dense looking bones with thick cortices. All bones of the skeleton were involved. Most importantly, the shapes of all the bones were entirely normal. The spinal BMC was 94.48 grams in L1-4, and the spinal BMD was 1.667 gm/cm$^2$ in L1-4. BMD was 5.62 standard deviations (SD) above peak skeletal mass for women. These were measured by DXA using a Hologic 2000~. Her mother was then scanned and a lumbar$_2$ spinal BMC of 58.05 grams and BMD of 1.500 gm/cm$^2$ were found. Her mother's values place her 4.12 SD above peak mass and 4.98 SD above her peers. Her mother was 51 years old, stood 65 inches and weighed 140 pounds. Her mother was in excellent health with no history of musculoskeletal or other symptoms. Her father's lumbar BMC was 75.33 grams and his BMD was 1.118 gm/cm$^2$. These values place him 0.25 SD above peak bone mass for males. He was in good health, stood 72 inches tall, and weighed 187 pounds.

These clinical data suggested that the propositus inherited a trait from her mother, which resulted in very high bone mass, but an otherwise normal skeleton, and attention was focused on the maternal kindred. In U.S. Pat. No. 5,691,153, twenty-two of these members had measurement of bone Mass by DXA. In one case, the maternal grandfather of the propositus, was deceased, however, medical records, antemortem skeletal radiographs and a gall bladder specimen embedded in paraffin for DNA genotyping were obtained. His radiographs showed obvious extreme density of all of the bones available for examination including the femur and the spine, and he was included among the-affected members. In this invention, the pedigree has been expanded to include 37 informative individuals. These additions are a significant improvement over the original kinship (Johnson et al., *Am. J. Hum. Genet.*, 60:1326-1332 (1997)) because, among the fourteen individuals added since the original study, two individuals harbor key crossovers. X-linkage is ruled out by the presence of male-to-male transmission from individual 12 to 14 and 15.

Example 2

The present invention describes DNA sequences derived from two BAC clones from the HBM gene region, as evident in Table 7 below, which is an assembly of these clones. Clone b200e21-h (ATCC No. 980812; SEQ ID NOS: 10-11) was deposited at the American Type Culture Collection (ATCC), 10801 University Blvd., Manassas, Va. 20110-2209 U.S.A., on Dec. 30, 1997. Clone b527d12-h (ATCC No. 980720; SEQ ID NOS: 5-9) was deposited at the American Type Culture Collection (ATCC), 10801 University Blvd., Manassas, Va. 20110-2209 U.S.A., on Oct. 2, 1998. These sequences are unique reagents that can be used by one skilled in the art to identify DNA probes for the Zmax1 gene, PCR primers to amplify the gene, nucleotide polymorphisms in the Zmax1 gene, or regulatory elements of the Zmax1 gene.

Example 3

Yeast-2 Hybrid Screen for Peptide Aptamer Sequences to Dkk-1

Peptide aptamer library construction. A peptide aptamer library, Tpep, was constructed, which provides a means to identify chimeric proteins that bind to a protein target (or bait) of interest using classic yeast two hybrid (Y2H) assays. The Tpep library is a combinatorial aptamer library composed of constrained random peptides, expressed within the context of the disulfide loop of E. coli thioredoxin (trxA), and as C-termini fusion to the S. cerevisiae Ga14 activation domain. The Tpep library was generated using a restriction enzyme modified recombinant Y2H prey vector, pPC86 (Gibco), which contains the trxA scaffold protein.

Generation of aptamer-encoding sequences. Aptamer-encoding sequences were produced as follows. DNA encoding random stretches of approximately sixteen amino acids surrounded by appropriate restriction sites were generated by semi-random oligonucleotide synthesis. The synthetic oligonucleotides were PCR-amplified, restriction digested, and cloned into the permissive sites within the trkA scaffold protein. The cloning strategy was to insert the random oligonucleotide sequence is in-frame with the scaffold protein coding sequence, resulting in expression of a scaffold protein-aptamer chimera. The scaffold protein is itself in-frame with the activation domain of Ga14, within the pPC86 vector that is appropriate for the aptamer to be expressed and functional in a regular Y2H assay. Additional methods of preparing aptamers would be apparent to the skilled artisan.

Generation of a permissive recombinant pPC86 vector containing the trxA coding sequence. First the RsrII restriction site located within the Ga14 activation domain of pPC86 (Gibco) was eliminated by site-directed mutagenesis (Quickchange™ kit, Stratagene). The amino acid sequence of the Ga14 activation domain was unchanged by this modification. The strength of different control interactions was verified to be unchanged by the modification.

Second, the E. coli trxA coding sequence was cloned into the SalI and NotI sites of the RsrII-modified pPC86. EcoRI and SpeI sites were then introduced within the trxA RsrII site. The oligonucleotides encoding the peptide aptamers were cloned into the EcoRI and SpeI sites of the resulting vector.

TABLE 13

| Contig | ATCC No. | SEQ ID NO. | Length (base pairs) |
|---|---|---|---|
| b527d12-h_contig302G | 980720 | 5 | 3096 |
| b527d12-h_contig306G | 980720 | 6 | 26928 |
| b527d12-h_contig307G | 980720 | 7 | 29430 |
| b527d12-h_contig308G | 980720 | 8 | 33769 |
| b527d12-h_contig309G | 980720 | 9 | 72049 |
| b200e21-h_contig1 | 980812 | 10 | 8705 |
| b200e21-h_contig4 | 980812 | 11 | 66933 |

Example 4

Generation of Antibodies

In each of the following antibody-generating examples, the synthesis of these linear peptides is followed by injection into two New Zealand Rabbits. Subsequent boosts and bleeds are taken according to a standard ten-week protocol. The end-user receives back 5 mgs of peptide, aliquots of pre-bleeds,. roughly 80 ml of crude sera from each of the two rabbits and, and ELISA titration data is obtained.

Figure 32:
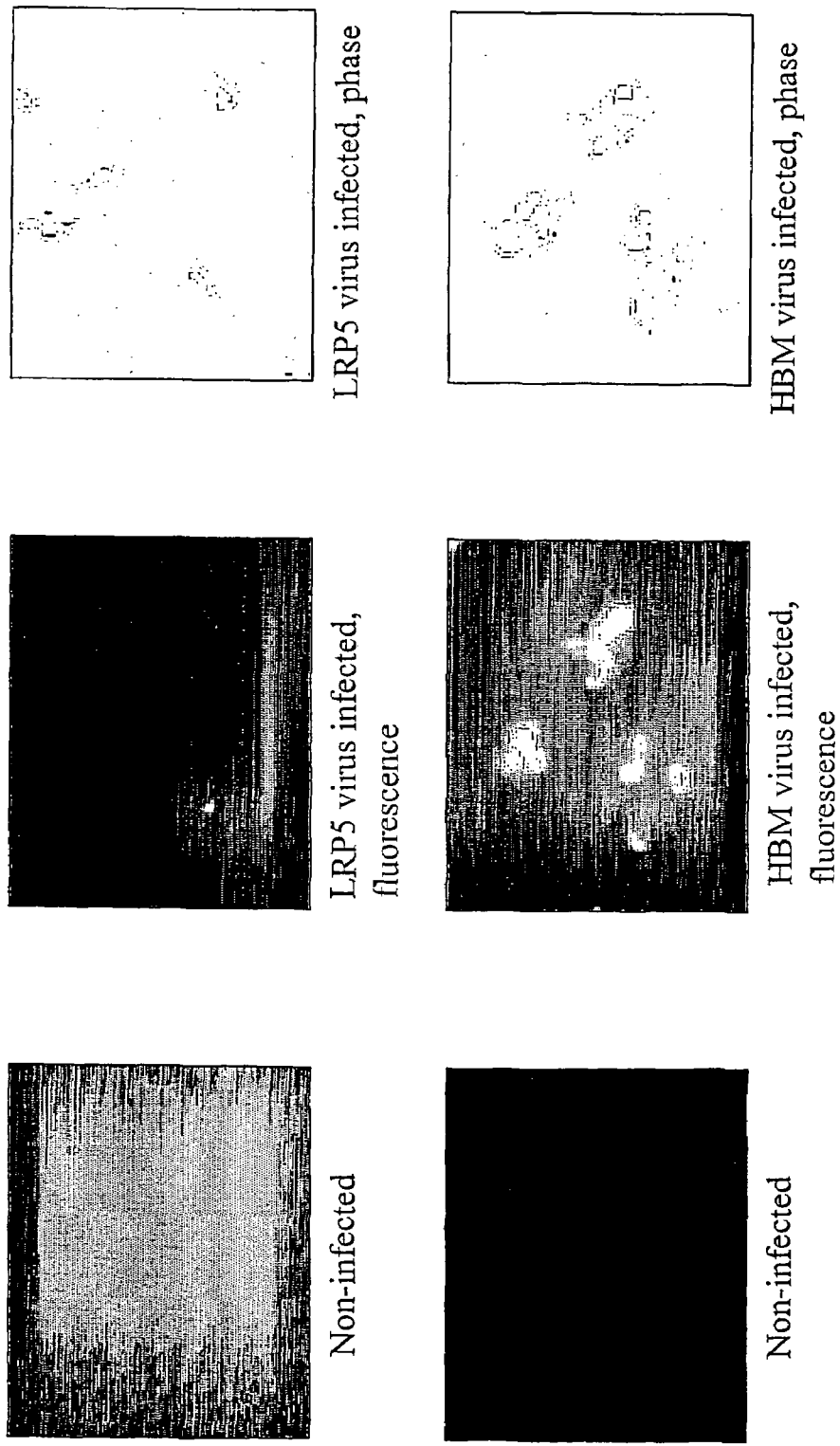
FIG. 32 shows the differential binding of an antibody generated to a sequence (a.a. 165-177) containing the HBM mutation in LRP5 in LRP5 and HBM virus-infected cells.

Generation of LRP5 Polymorphism-specific antibodies. Antibodies were generated to the following peptides to obtain antibodies which distinguish the HBM polymorphism versus wild-type LRP5/Zmax: MYWTDWVETPRIE (SEQ ID NO: 952) (mutant peptide) and MYWTDWGETPRIE (SEQ ID NO: 953) (wild-type peptide for negative selection). Immunofluorescence data confirmed that the antibody, after affinity purification, is specific for HBM and does not recognize LRP5 (FIG. 32).

Generation of LRP5 Monospecific antibodies. LRP5 monospecific polyclonal antibodies were generated to the following amino acid sequences of LRP5: Peptide 1 (a.a. 265-277) -KRTGGKRKEILSA (SEQ ID NO: 954), Peptide 2 (a.a. 1178-1194) -ERVEKTTGDKRTRIQGR (SEQ ID NO: 955) and Peptide 3 (a.a. 1352-1375) -KQQCDSFPDCIDGSDE (SEQ ID NO: 956). Immunofluorescence confirmed that the antibody generated detects LRP5.

Generation of Dkk-1 monospecific polyclonal antibodies. Dkk-1 monospecific polyclonal antibodies were generated to the following amino acid sequences of Dkk-1:
Peptide 1- GNKYQTIDNYQPYPC (SEQ ID NO: 957),
Peptide 2- LDGYSRRTTLSSKMYHTKGQEG (SEQ ID NO: 958),
Peptide 3- RIQKDHHQASNSSRLHTCQRH (SEQ ID NO: 959),
Peptide 4- RGEIEETITESFGND (SEQ ID NO: 960), and
Peptide 5- EIFQRCGEGLSCRIQKD (SEQ ID NO: 961) of human Dkk-1. Western Blots demonstrated that the antibodies generated against peptides 2 and 4 are specific toward Dkk-1.

Example 5

Effects of Exogenous Dkk-1 on Wnt-mediated Signaling in the Xenopus Embryo Assay Xenopus embryos are an informative and well-established in vivo assay system to evaluate the modulation of Wnt signaling (McMahon et al., 1989 Cell 58: 1075-84; Smith et al., 1991 reviewed in Wodarz and Nusse, 1998).

Modification of the Wnt signaling pathway can be visualized by examining the embryos for a dorsalization phenotype (duplicated body axis) after RNA injection into the ventral blastomere at the 4- or 8-cell stage. On the molecular level, phenotypes can be analyzed by looking for expression of various marker genes in stage 10.5 embryos. Such markers would include general endoderm, mesoderm, and ectoderm markers as well as a variety of tissue-specific transcripts.

Analysis can be done by RT-PCR/TaqMan® and can be done on whole embryo tissue or in a more restricted fashion (microdissection). Because this system is very flexible and rapid, by injecting combinations of transcripts, such as HBM and different Wnts or Wnt antagonists, the mechanism of HBM in the Wnt pathway can thereby be dissected. Furthermore, investigations are conducted to determine whether Zmax/LRP5 and HBM differentially modulate Wnt signaling either alone, or in combination with other components. Previous studies have demonstrated that LRP6 alone or LRP5+ Wnt5a were able to induce axis duplication (dorsalization) in this system (Tamai et al., 2000 Nature 407: 530-35).

Constructs for *Xenopus* Expression (Vector pCS2+). Constructs were prepared using the vector pCS2+. DNA inserts were subcloned in the sense orientation with respect to the vector SP6 promoter. The pCS2+ vector contains an SV40 virus polyadenylation signal and T3 promoter sequence (for generation of antisense mRNA) downstream of the insert.

Full length Zmax/LRP5 and HBM ORF cDNA: Insert cDNA was isolated from the full length cDNA retrovirus constructs (with optimized Kozak sequences) by BglII-EcoRI digestion and subcloned into the BamHI-EcoRI sites of the pCS2+ vector. cDNAs encoding a HBM-like molecule could be subcloned into pCS2+ vectors and processed similarly by one of ordinary skill.

Full length XWnt8: This cDNA was PCR amplified from a Xenopus embryo cDNA library using oligos 114484 (SEQ ID NO: 962) (5'-CAGTGAATTCACCATGCAAAACAC-CACTTTGTTC-3') and 114487 (SEQ ID NO: 963) (5'-CAGTTGCGGCCGCTCATCTCCGGTGGCCTCTG-3'). The oligos were designed to amplify the ORF with a consensus Kozak sequence at the 5' end as determined from GenBank #X57234. PCR was carried out using the following conditions: 96° C., 45 sec.; 63° C., 45 sec.; 72° C., 2 min. for 30 cycles. The resulting PCR product was purified, subcloned into pCRII-TOPO (Invitrogen Corp.), sequence verified, and digested with BamHI/XhoI. This insert was subcloned into the vector at the BamHI-XhoI sites.

Full length Wnt5a: A murine Wnt5a cDNA clone was purchased from Upstate Biotechnology (Lake Placid, N.Y.) and subcloned into the EcoRI site of the vector. Sequencing confirmed insert orientation.

Full length human Dkk-1: A human cDNA with GenBank accession number AF127563 was available in the public database. Using this sequence, PCR primers were designed to amplify the open reading frame with a consensus Kozak sequence immediately upstream of the initiating ATG. Oligos 117162 (SEQ ID NO: 2M) (5'-CAATAGTCGACGAAT-TCACCATGGCTCTGGGCGCAGCGG-3') and 117163 (SEQ ID NO: 965) (5'-GTATTGCGGCCGCTCTAGATT-AGTGTCTCTGACAAGTGTGAA-3') were used to screen a human uterus cDNA library by PCR. The resulting PCR product was purified, subcloned into pCRII-TOPO (Invitrogen Corp.), sequence verified, and digested with EcoRI/XhoI. This insert was subcloned into the pCS2+ vector at the EcoRI-XhoI sites.

Full lenath human Dkk-2: A full length cDNA encoding human Dkk-2 was isolated to investigate the specificity of the Zmax/LRP5/HBM interaction with the Dkk family of molecules. Dkk-1 was identified in yeast as a potential binding partner of Zmax/LRP5/HBM. Dkk-1 has also been shown in the literature to be an antagonist of the Wnt signaling pathway, while Dkk-2 is not (Krupnik et al., 1999). The Dkk-2 full length cDNA serves as a tool to discriminate the specificity and biological significance of Zmax/LRP5/HBM interactions with the Dkk family (e.g., Dkk-1, Dkk-2, Dkk-3, Dkk-4, Soggy, their homologs and variant, etc.). A human cDNA sequence for Dkk-2 (GenBank Accession No. NM_014421) was available in the public database. Using this sequence, PCR primers were designed to amplify the open reading frame with a consensus Kozak sequence immediately upstream of the initiating ATG. Oligos 51409 (SEQ ID NO: 966) (5'-CTAACGGATCCACCATGGCCGCGTTGAT-GCGG-3') and 51411 (SEQ ID NO: 967) (5'-GATTCGAAT-TCTCAAATTTCTGACACACATGG-3') were used to screen human embryo and brain cDNA libraries by PCR. The resulting PCR product was purified, subcloned into pCRII-TOPO, sequence verified, and digested with BamHI/EcoRI. This insert was subcloned into the pCS2+ vector at the BamHI-EcoRI sites.

Full length LRP6 was isolated from the pED6dpc4 vector by XhoI-XbaI digestion. The full length cDNA was reassembled into the XhoI-XbaI sites of pCS2+. Insert orientation was confirmed by DNA sequencing.

mRNA Synthesis and Microinjection Protocol. mRNA for microinjection into *Xenopus* embryos is generated by in vitro transcription using the cDNA constructs in the pCS2+ vector described above as template. RNA is synthesized using the Ambion mMessage mMachine high yield capped RNA transcription kit (Cat. #1340) following the manufacturer's specifications for the Sp6 polymerase reactions. RNA products were brought up to a final volume of 50 µl in sterile, glass-distilled water and purified over Quick Spin Columns for Radiolabeled RNA Purification G50-Sephadex (Roche, Cat. #1274015) following the manufacturer's specifications. The resulting eluate was finally extracted with phenol:chloroform:isoamyl alcohol and isopropanol precipitated using standard protocols (Sambrook-et al., 1989). Final RNA volumes were approximately 50 µl. RNA concentration was determined by absorbance values at 260 nm and 280 nm. RNA integrity was visualized by ethidium bromide staining of denaturing (formaldehyde) agarose gel electrophoresis (Sambrook et al., 1989). Various amounts of RNA (2 pg to 1 ng) are injected into the ventral blastomere of the 4- or 8-cell *Xenopus* embryo. These protocols are described in Moon et al., 1989 *Technique-J. of Methods in Cell & Mol Biol.* 1: 76-89; and Peng, 1991 *Meth. Cell. Biol.* 36: 657-62.

Figure 33:
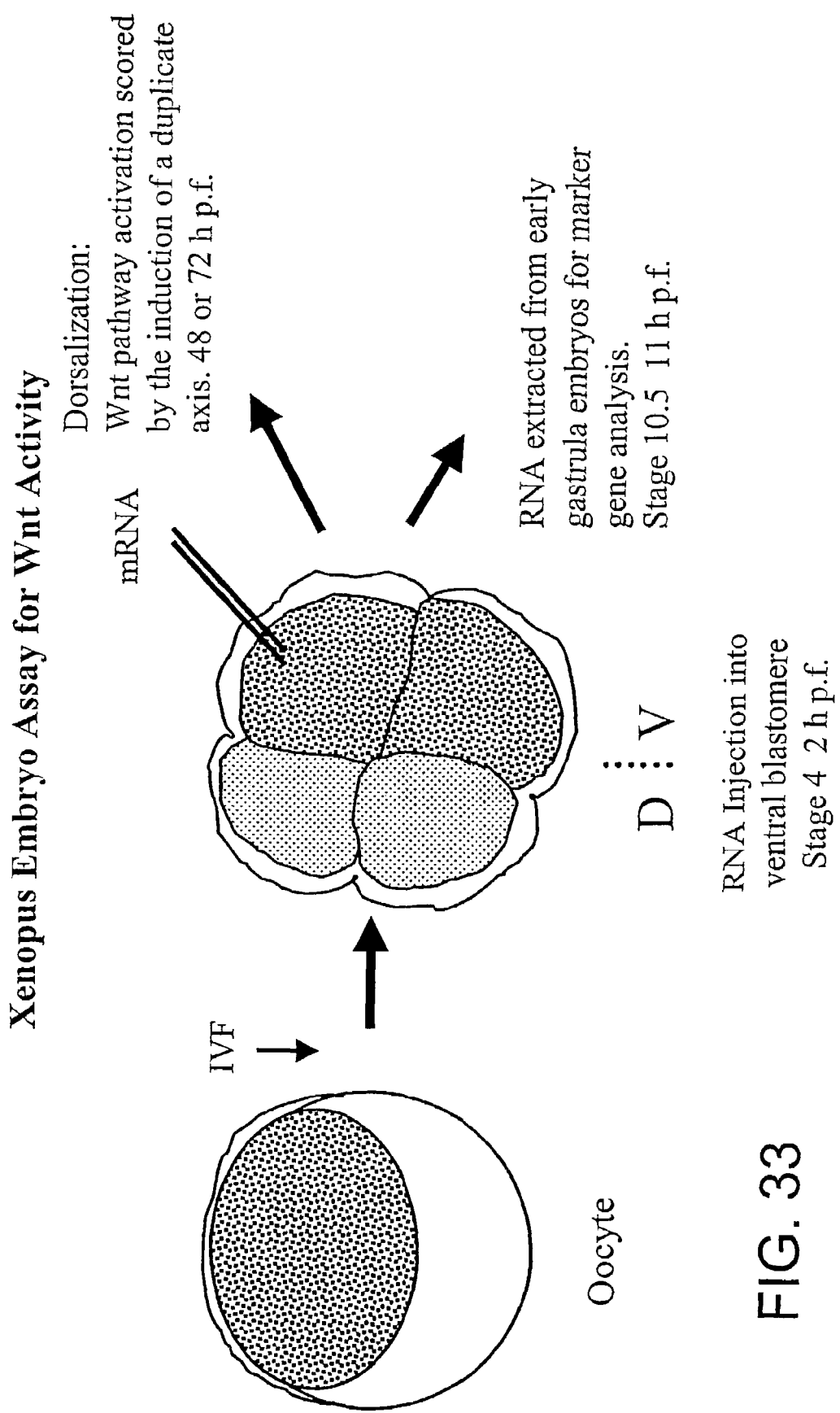
FIG. 33 shows a diagram of the *Xenopus* Embryo Assay for Wnt activity.
Figure 34:
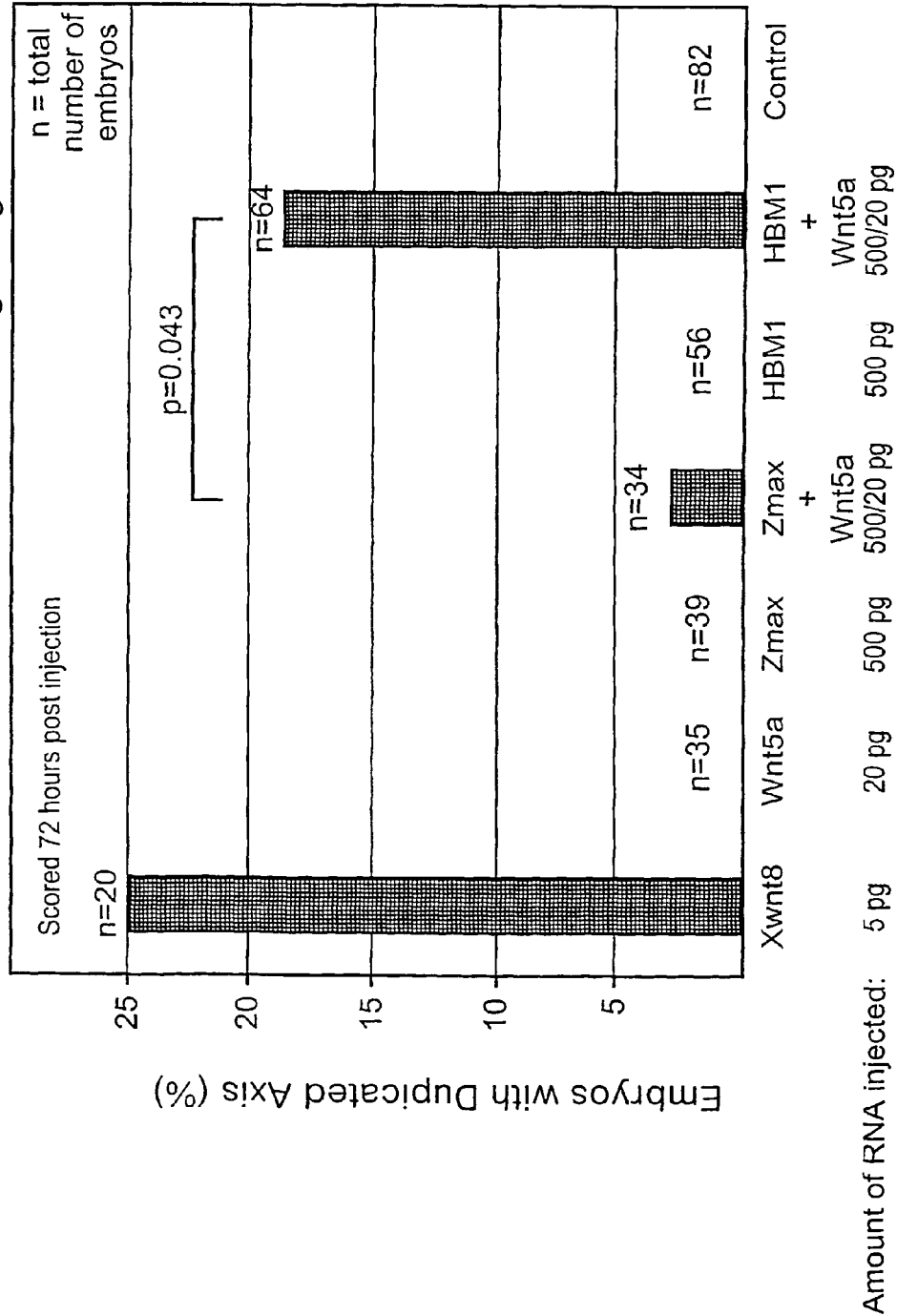
FIG. 34 shows the effects of Zmax/LRP5 and HBM on Wnt signaling in the *Xenopus* embryo assay.

Screening for Duplicated Body Axis. In vitro transcribed RNA is purified and injected into a ventral blasomere of the 4- or 8-cell *Xenopus* embryo (approx. 2 hours post-fertilization). At stage 10.5 (approx. 11 hours post-fertilization), the injected embryos are cultured for a total of 72 hours and then screened for the presence of a duplicated body axis (dorsalization) (FIG. 33). Using XWnt8-injected (2-10 pg) as a positive control (Christian et al., 1991) and water-injected or non-injected embryos as negative controls, we replicated the published observation that Zmax(LRP5)+Wnt5a (500 and 20 pg, respectively) could induce axis duplication. Wnt5a (20 pg) alone could not induce axis duplication (as previously reported by Moon et al., 1993). We have also injected GFP RNA (100-770 pg) as a negative control to show that the amount of RNA injected is not perturbing embryo development (not shown). Strikingly, HBM+Wnt5a (500 and 20 pg, respectively) yielded an approximately 3.5 fold more robust response of the phenotype (p=0.043 by Fisher's exact test) compared to Zmax(LRP5)+Wnt5a, suggesting that the HBM mutation is activating the Wnt pathway (FIGS. 34 and 35). The HBM(Wnt5a embryos also appear to be more "anteriorized" than the Zmax(LRP5)/Wnt5a embryos, again suggestive of a gain-of-function mutation.

Figure 36:
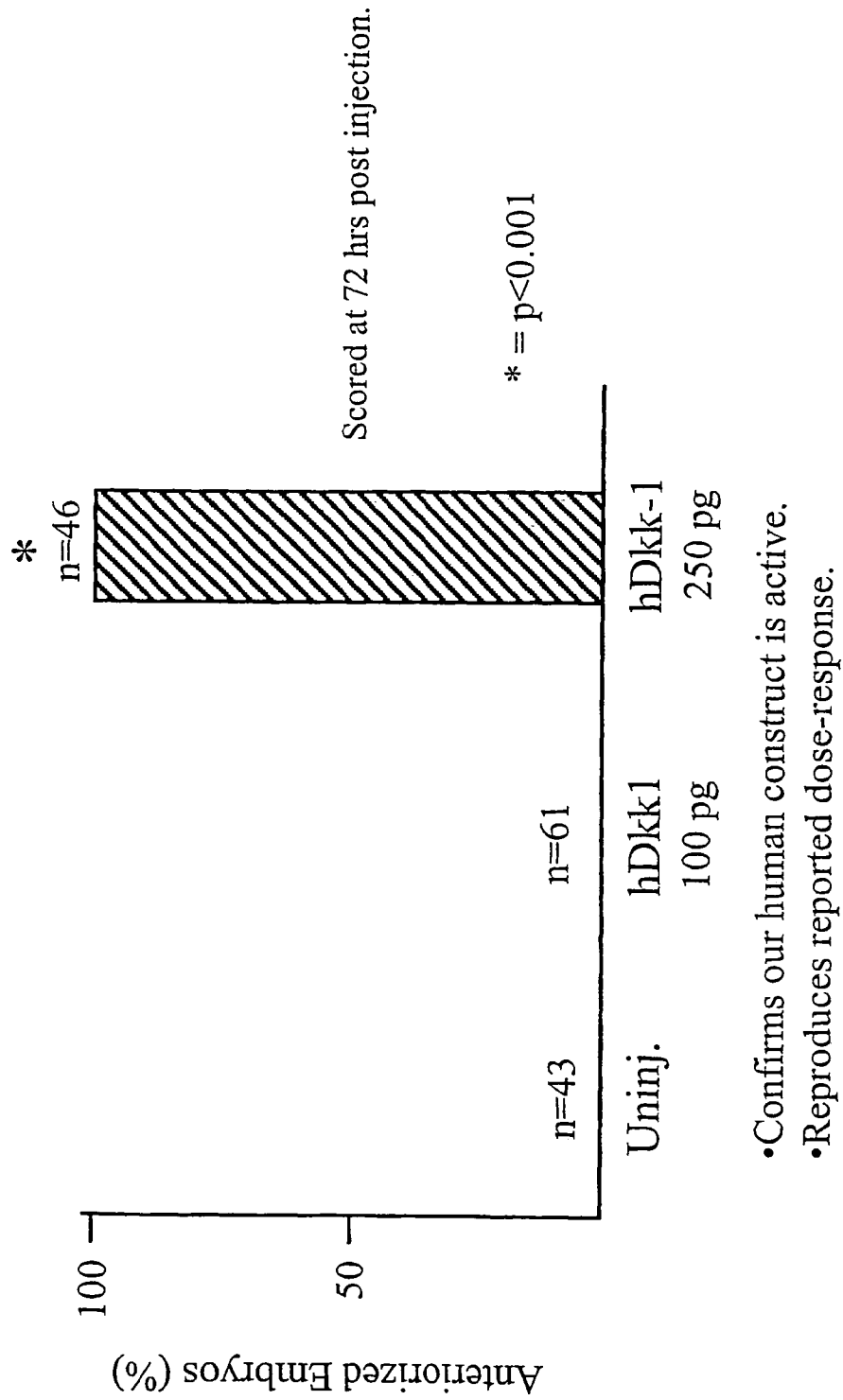
FIG. 36 shows the effects of human Dkk-1 on the repression of the canonical Wnt pathway.

The role of Dkk-1 as a modulator of Zmax/LRP5- and HBM-mediated Wnt signaling was investigated. Literature reports have previously characterized Xenopus and murine Dkk-1 as antagonists of the canonical Wnt pathway in the Xenopus system (Glinka et al., 1998 Nature 391: 357-62). Using the human Dkk-1 construct, a dose-response assay was performed to confirm that our construct was functional and to identify the optimal amount of RNA for microinjection. Using 250 pg/embryo of hDkk-1 RNA, over 90% (p<0.001) of the embryos were observed to display enlarged anterior structures (big heads) as anticipated from the published reports (FIG. 36).

Figure 37:
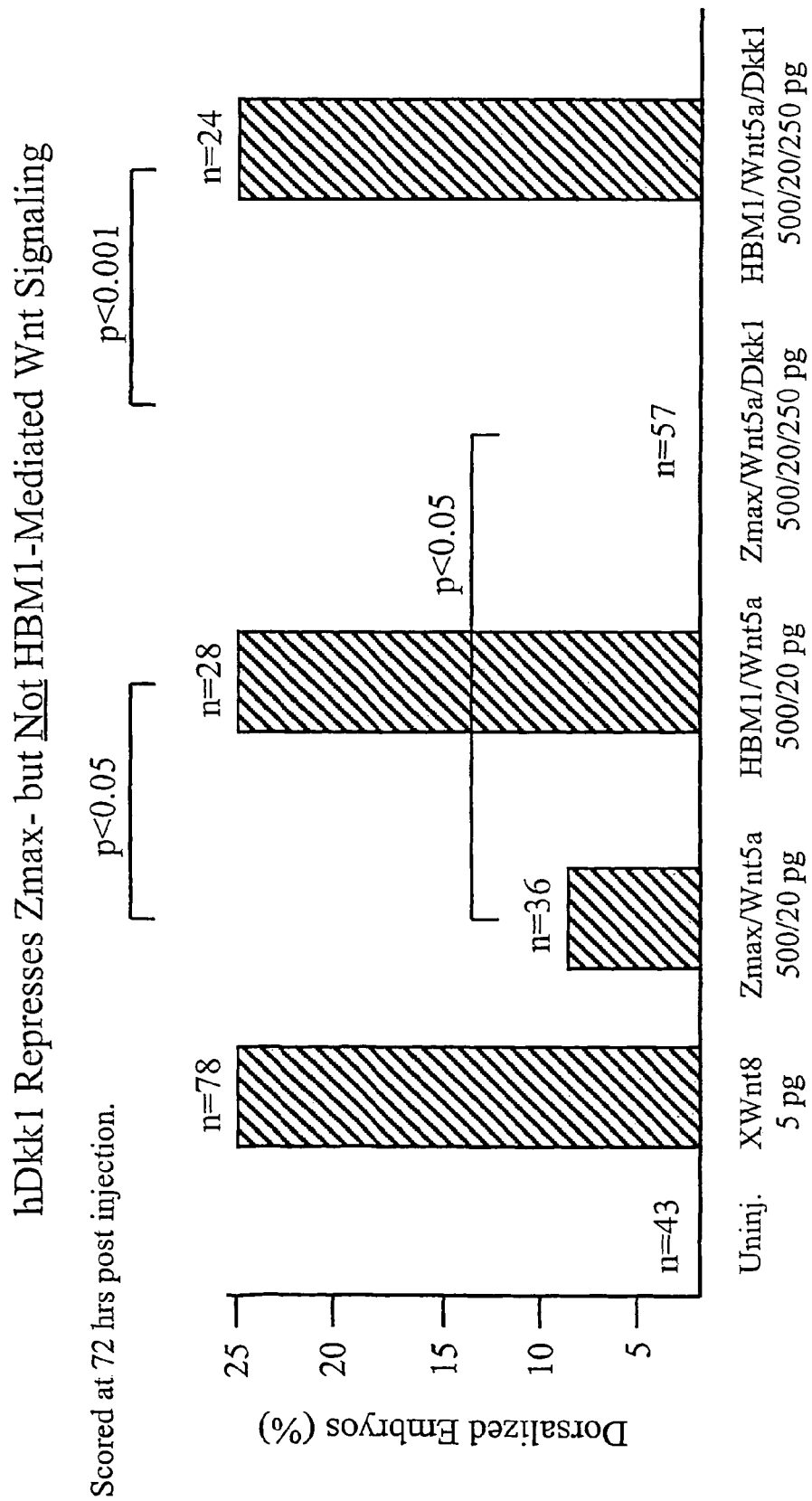
FIG. 37 shows the effects of human Dkk-1 on Zmax/LRP5 and HBM-mediated Wnt signaling.

The mechanism of hDkk-1 modulation of Wnt signaling in the presence of Zmax/LRP5 or HBM was also investigated. Without any hDkk-1 present, it was confirmed that HBM+Wnt5a was a more potent activator of Writ signaling than Zmax/LRP5+Wnt5a (p<0.05). Interestingly, in the presence of hDkk-1 (250 pg), Zmax/LRP5-mediated Wnt signaling was repressed (p<0.05) but hDkk-1 was unable to repress HBM-mediated Wnt signaling (p<0.01) (FIG. 37). The specificity of this observation can be further addressed by investigating other members of the Dkk family, other Wnt genes, LRP6, additional Zmax/LRP5 mutants, and the peptide aptamers.

Example 6

Effects of Exogenous Dkk and LRP5 on Wnt Signaling in the TCF-luciferase Assay

Wnt activity can be antagonized by many proteins including secreted Frizzled related proteins (SFRPs), Cerberus, Wnt Inhibitory Factor-1 and Dkk-1 (Krupnik et al., 1999). The Dkk family of proteins consists of Dkk-1-4 and Soggy, a Dkk-3-like protein. Dkk-1 and Dkk-4 have been shown to antagonize Wnt mediated Xenopus embryo development, whereas Dkk-2, Dkk-3, and Soggy do not. Unlike many of these proteins that antagonize Wnt activity by directly interacting with Wnt proteins, Dkk-1 acts by binding to two recently identified Wnt coreceptors, LRP5 and LRP6 (Mao et al., 2001; Bafico et al., 2001). The details of this interaction have been examined by the present inventors and Mao et al. using deletion constructs of LRP6, which demonstrated that EGF repeats 3 and 4 are important for Dkk-1 interaction. Accordingly, the activity of two Dkk proteins, Dkk-1 and Dkk-2, were investigated with various Wnt members, LRP5, LRP6, and the mutant form of LRP5, designated HBM. The present invention explores whether there is any functional difference between LRP5 and HBM with regard to Dkk action on Wnt mediated signaling. Various reagents were developed, including Dkk-1 peptides, constrained LRP5 peptide aptamers, constrained Dkk-1 peptide aptamers and polyclonal antibodies to Dkk-1 (in Example 4 above) to identify factors that mimic HBM mediated Wnt signaling.

Figure 40:
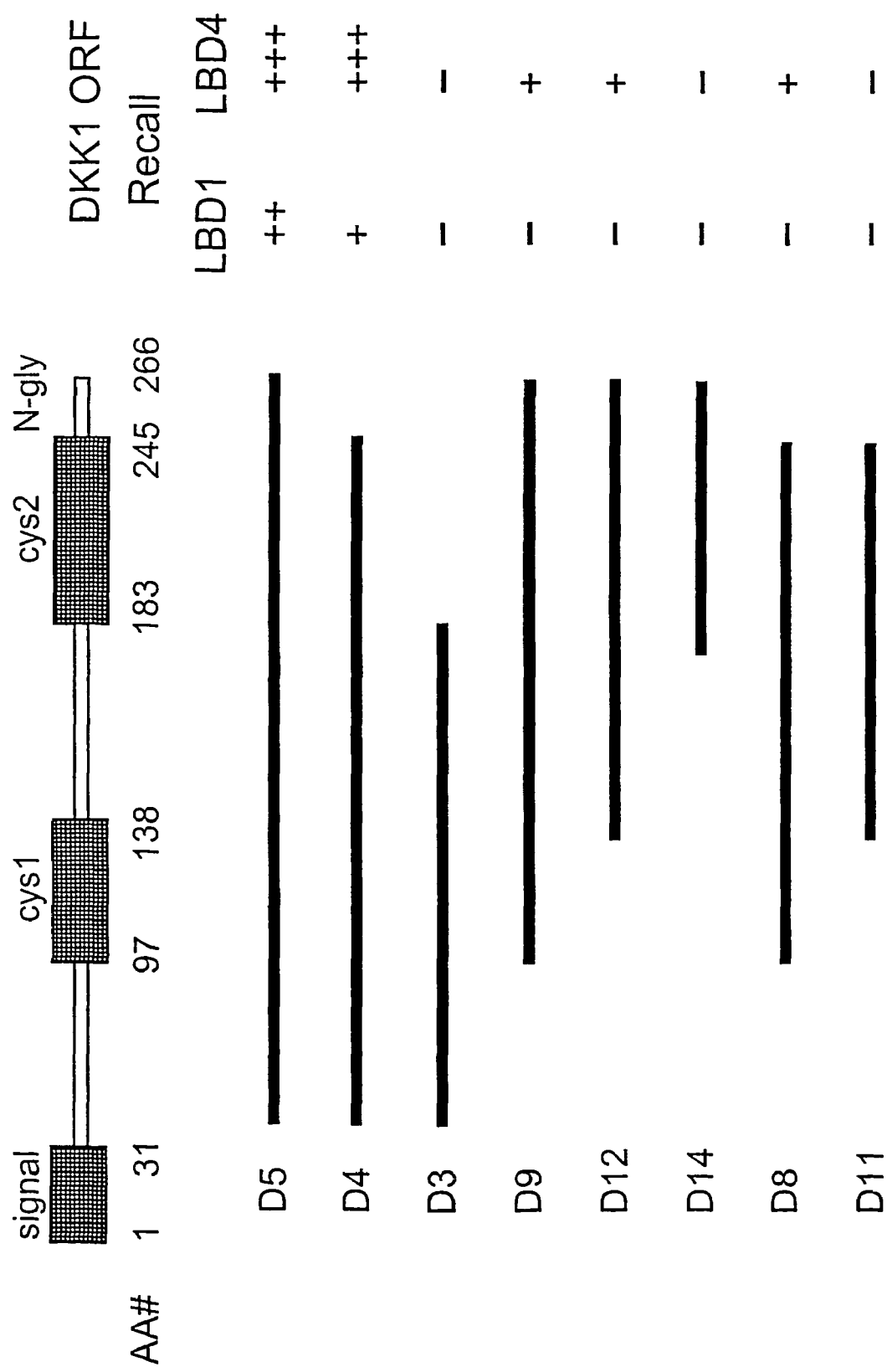
FIG. 40 shows the results of a minimum interaction domain mapping screen of Dkk-1 with LRP5. At the top, a map of Dkk-1 showing the location of the signal sequence, and cysteine rich domains 1 and 2. Below, the extent of domains examined using LRP5 LBD baits, LBD1 and LBD4. To the right, scoring of the binding results observed in the experiment.

Methods. Various LRP5 constrained peptides were developed. Specifically, four peptides that interact with the LBD of LRP5 (FIG. 38,constructs OST259-262 in FIG. 39) and three peptides that interact with the cytoplasmic domain of LRP5 (constructs OST266-OST268 in FIG. 39). In addition two Dkk-1 peptides were developed: constructs OST264 and OST265 in FIG. 39, corresponding to Dkk-1 amino acids 139-266 and 96-245, containing the smallest region of Dkk-1 that interacts with LRP5 (FIG. 40). The cDNA clones encoding the LRP5 LBD interacting peptides and the Dkk-1 peptides were subcloned into pcDNA3.1 with the addition of a Kozak and signal sequence to target the peptide for secretion. The constructs encoding the three peptides interacting with the cytoplasmic domain of LRP5 were also subcloned into pcDNA3.1. However, these latter constructs do not contain a signal sequence.

HOB-03-CE6 osteoblastic cells developed by Wyeth Ayerst (Philadelphia, Pa.) were seeded into 24-well plates at 150,000 cells per well in 1 ml of the growth media (D-MEM/F12 phenol red-free) containing 10% (v/v) heat-inactivated FBS, 1× penicillin streptomycin, and 1× Glutamax-1, and incubated overnight at 34° C. The following day, the cells were transfected using Lipofectamine 2000® (as described by the manufacturer, Invitrogen) in OptiMEM (Invitrogen) with 0.35 µg /well of LRP5, HBM, or control plasmid DNA (empty vector pcDNA3.1) and either Wnt1 or Wnt3a plasmid DNA. Similar experiments were performed with LRP6 plasmid DNA (0.35 µg/well) or a control pEDdpc4 empty vector. Furthermore, each of these groups were then divided into three groups, those receiving 0.35 µg/well Dkk-1, Dkk-2, or pcDNA3.1 control DNA. All wells were transfected with 0.025 µg/well of CMV beta-galactosidase plasmid DNA and 0.35 µg/well 16× TCF(AS)-luciferase reporter DNA (developed by Ramesh Bhat, Wyeth-Ayerst (Philadelphia, Pa.)). After 4 hours of incubation, the cells were rinsed and 1 ml of fresh growth media was added to each well. The cells were cultured overnight at 34° C., followed by awash and a change of media. Cells were cultured for an additional 18-24 hours at 37° C. Cells were then lysed with 50 µl/well of 1× lysis buffer. The extracts were assayed for beta-galactosidase activity (Galacto Reaction Buffer Diluent & Light Emission Accelerator, Tropix) using 5 µl extract+50 µl beta-galactosidase diluent and luciferase activity (Luciferase Assay Reagent, Promega) using 20 µl extract.

U2OS human osteosarcoma cells were also utilized. U2OS cells (ATCC) were seeded into 96-well plates at 30,000 cells per well in 200 µl of the growth media (McCoy's 5A) containing 10% (v/v) heat-inactivated FBS, 1× penicillin streptomycin, and 1× Glutamax-1, and incubated overnight at 37° C. The following day, the media was replaced with OptiMEM (Invitrogen) and cells were transfected using Lipofectamine 2000® (as described by the manufacturer, Invitrogen) with 0.005 µg/well of LRP5, HBM, LRP6 or contol plasmid DNA (empty vector pcDNA3.1) and either Wnt1 (0.0025 µg/well) or Wnt3a (0.0025 µg/well) plasmid DNA. In addition, the 16×-(AS) TCF-TK-firefly-luciferase and control TK-renilla luciferase (Promega Corp.) were co-transfected at 0.3 µg/well and 0.06. µg/well respectively in all experiments. Furthermore, each of these groups was then divided into different groups, those receiving 0.05 µg/well Dkk-1, Dkk-2, Dkk3, Dkk1-Alkaline Phosphatase (AP), mutant Dkk-1 (C220A), Soggy or pcDNA3.1 control DNA. In other experiments, cells were co-transfected with 0.005 µg/well of LRP5, 0.0025 µg/well of Wnt1 or Wnt3a (using 0.0025 µg/well of a control pcDNA3.1) with LRP5-interacting aptamers (0.05 µg/well). Cells were cultured for an additional 18-20 hours at 37° C. Culture medium was removed. Cells were cultured for an additional 18-20 hours at 37° C. Culture medium was removed. Cells were then lysed with 100 µl/well of 1× Passive Lysis Buffer (PLB) of Dual Luciferase Reagent lit (DLR-kit-Promega Corp.) 20 µl of the lysates were combined with LARII reagent of DLR-kit and assayed for TCF-firefly luciferase signal in Top Count (Packard) instrument. After measuring the Firefly readings, 100 µl of the "Stop and Go" reagent of DLR kit that contains a quencher and a substrate for renilla luciferase was added into each well. Immediately the renilla luciferase reading was measured using the Top Count (Packard) Instrument. The ratios of the TCF-firefly luciferase to control renilla readings were calculated for each well and the mean ratio of triplicate or more wells was expressed in all data.

Figure 41:
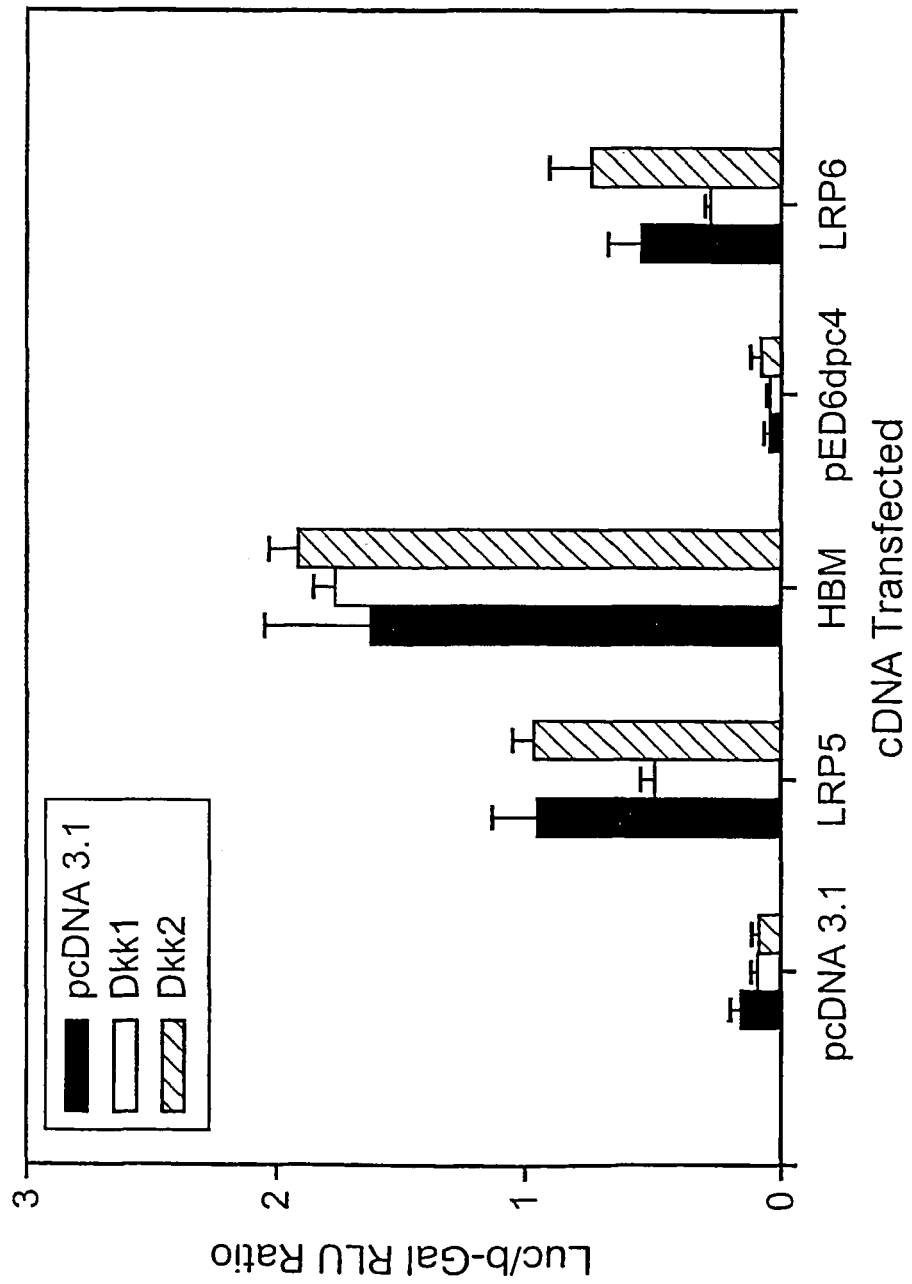
FIG. 41 shows the effects of Dkk-1 and Dkk-2 on Wnt1 signaling with coreceptors LRP5, HBM, and LRP6 in HOB03CE6 cells.
Figure 42:
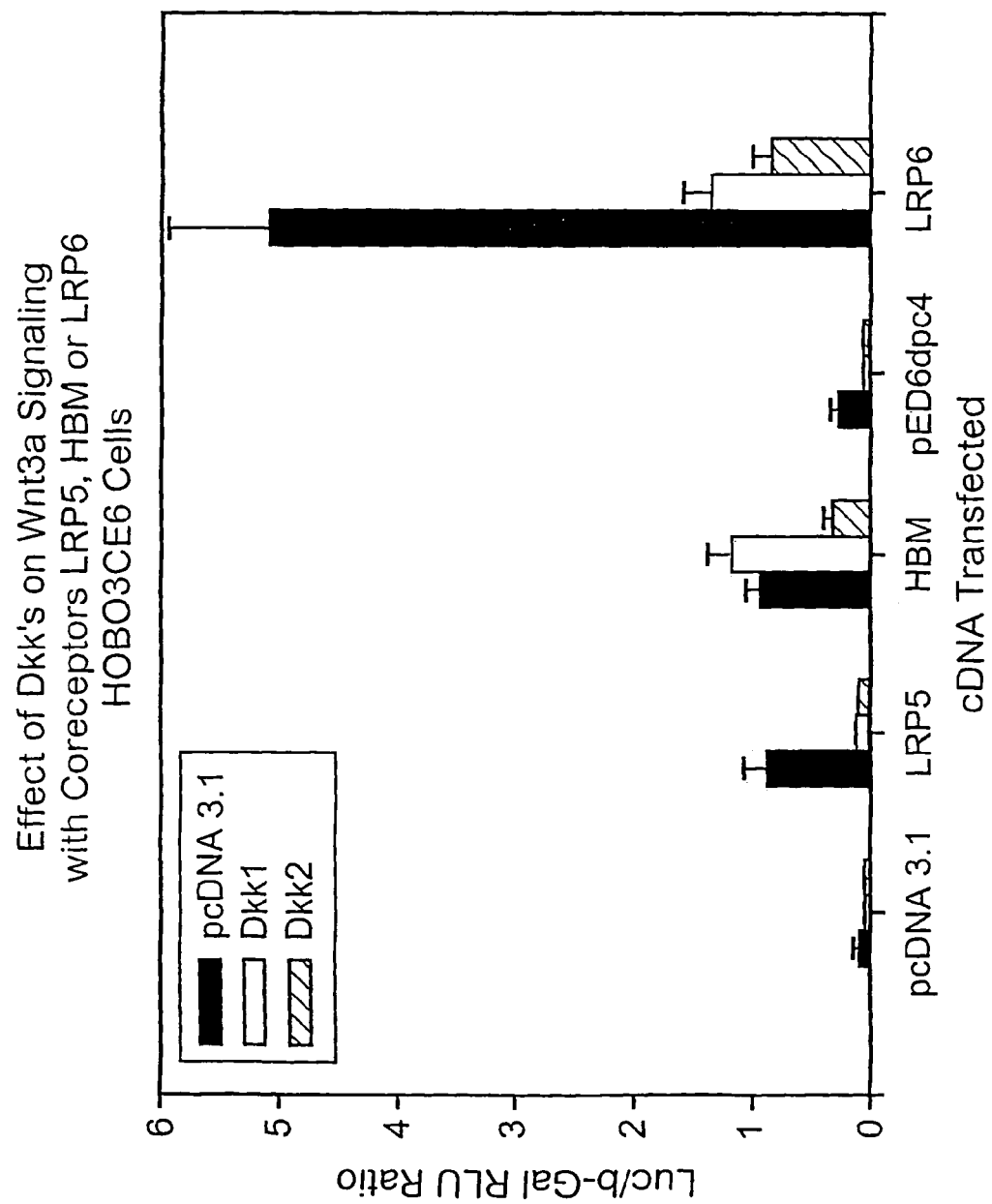
FIG. 42 shows the effects of Dkk-1 and Dkk-2 on Wnt3a signaling with coreceptors LRP5, HBM, and LRP6in HOB03CE6 cells.

Results. The results of these experiments demonstrate that Dkk-1, in the presence of Wnt1 and LRP5, significantly antagonized TCF-luciferase activity (FIG. 41). In marked contrast, Dkk-1 had no effect on HBM/Wnt1 mediated TCF-luciferase activity (FIG. 41). In similar experiments, Dkk-1 was also able to antagonize LRP5/Wnt3a but not HBM/Wnt3a mediated TCF-luciferase activity (FIG. 42). These results indicate that the HBM mutation renders Dkk-1 inactive as an antagonist of Wnt1 and Wnt3a signaling in HOB03CE6 osteoblastic cells. In other experiments with Wnt1, Dkk-1 had no effect on LRP5 or HBM mediated TCF-luciferase activity (FIG. 41). In contrast, with either LRP5 or HBM in the presence of Wnt3 a, Dkk-2 was able to antagonize the TCF-luciferase activity (FIG. 42). These latter results indicate that the HBM mutation has no effect on Dkk-2 action in the presence of Wnt3a. Experiments were also performed using the closely related LRP6 cDNA in HOB-03-CE6 cells. In these experiments, LRP6/Wnt1 and LRP6/Wnt3a mediated TCF-luciferase were regulated in the same manner as LRP5. Specifically, Dkk-1 antagonized LRP6/Wnt1 mediated TCF-luciferase activity, whereas Dkk-2 had no effect (FIG. 41). However, similar to the action of Dkk-2 with LRP5/Wnt3a, Dkk-2 was able to antagonize LRP6/Wnt3a mediated TCF-luciferase activity (FIG. 42).

Figure 43:
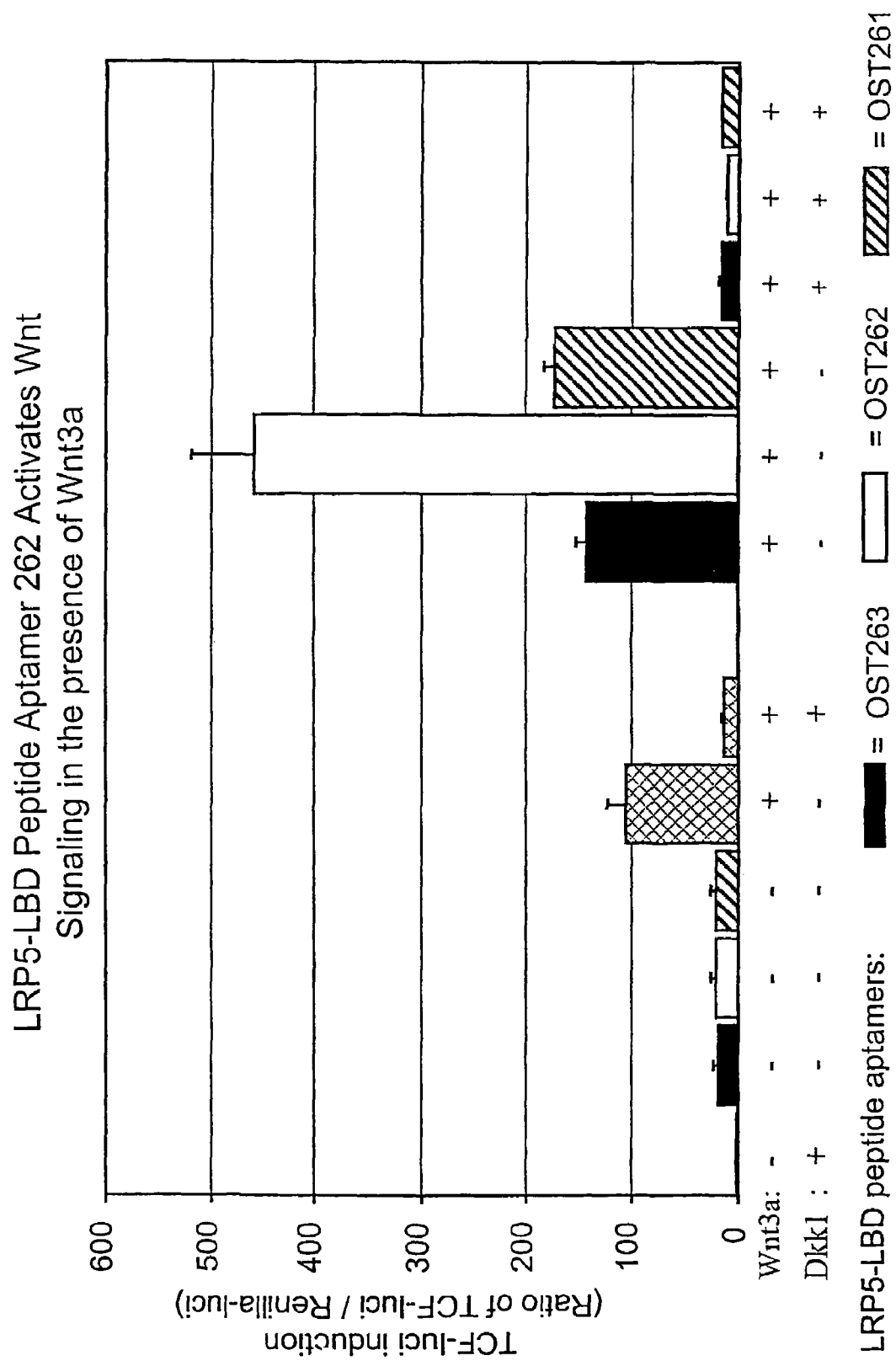
FIG. 43 demonstrates that the LRP5-LBD peptide aptamer 262 activates Wnt signaling in the presence of Wnt3a in U2OS cells.

The results in the U2OS cells show a robust effect of the OST262 LRP5 peptide aptamer activation of Wnt signaling in the presence of Wnt3a (FIG. 43). These functional results are confirmed by the results shown below in Example 7 using LRP5 peptide aptamers in the *Xenopus* assay. Such results affirmatively demonstrate that the effects of small molecules on LRP5/LRP6/HBM signaling can be detected using the TCF-luciferase assay.

These data demonstrate that there is a functional difference between LRP5 and HBM regarding the ability of Dkk-1 to antagonize Wnt1 and Wnt3a signaling. These data and previous data showing that Dkk-1 directly interacts with LRP5 suggests that the inability of Dkk-1 to antagonize HBM/Wnt signaling may in part contribute to the HBM phenotype. These experiments further demonstrate the ability to test various molecules (e.g., small molecules, aptamers, peptides, antibodies, LRP5 interacting proteins or Dkk-1 interacting proteins, and the like) for a LRP5 ligand that mimics HBM mediated Wnt signaling or factors that block Dkk-1 interaction with LRP5.

This was the assay that was used to show the responsiveness of two HBM-like variants. See FIGS. 29 and 30. The data also demonstrates that these variants are less susceptible to modulation by Dkk.

Example 7

Cell-Based Functional High-Throughput Assay

To develop a high throughput assay, the TCF-luciferase assay described in Example 6 was modified utilizing low level expression of endogenous LRP5/6 in U2OS and HEK293 cells. However, HOB-03-CE6 cells and any other cells which show a differential response to Dkk depending on whether LRP5, LRP6 or HBM are expressed. Using U2OS (human osteosarcoma) and HEK293 (ATCC) cells, the TCF-luciferase and tk-Renilla reporter element constructs were co-transfected along with Wnt3a/1 and Dkk. Wnt3a alone, by using endogenous LRP5/6, was able to stimulate TCF reporter gene activation. When Dkk, is co-transfected with Wnt3a/Wnt 1 and reporters (TCF-luci and tk-Renilla), Dkk represses reporter element activity. In addition, the TCF-luci signal is activated by Wnt3a/Wnt1 can be repressed by the addition of Dkk-enriched conditioned media to the cells containing Wnt3a/Wnt1 and reporters. The assay is further validated by the lack of TCF-reporter inhibition by a point mutant construct (C220A) of Dkk1.

The Dkk-mediated repression of the reporter is dependent upon the concentration of transfected Dkk cDNA or on the amount of Dkk-conditioned media added. In addition, the Dkk-mediated reporter suppression can be altered by the co-transfection of LRP5, LRP6, and HBM cDNAs in the U2OS or HEK293 cells. In general, U2OS cells show greater sensitivity to Dkk-mediated reporter suppression than that in HEK-293 cells. In U2OS cells, the transfection of LRP5/LRP6/HBM/HBM-like cDNA leads to moderate activation of TCF-luci in the absence of Wnt3a/Wnt1 transfection. This activation presumably utilizes the endogenous Wnts present in U2OS cells. Under this condition, Dkk1 can repress TCF-luci and shows a differential signal between LRP5 and HBM. By co-transfecting Wnt3a/Wnt1, there is a generalized increase in the TCF-luci signal in the assay. Further, one can detect Dkk-mediated differential repression of the reporter due to LRP5 and HBM cDNA expression as well as between LRP5 and LRP6 cDNA. The repression is maximal with LRP6, moderate with LRP5, and least with HBM cDNA expression. In addition, the assay can detect the functional impact of the LRP5 interacting peptide aptamers (FIG. 38), Dkk1 interacting aptamers and binding domains of Dkk-1 (FIG. 40; OST264 and OST265 of FIGS. 39 and 44).

Figure 45:
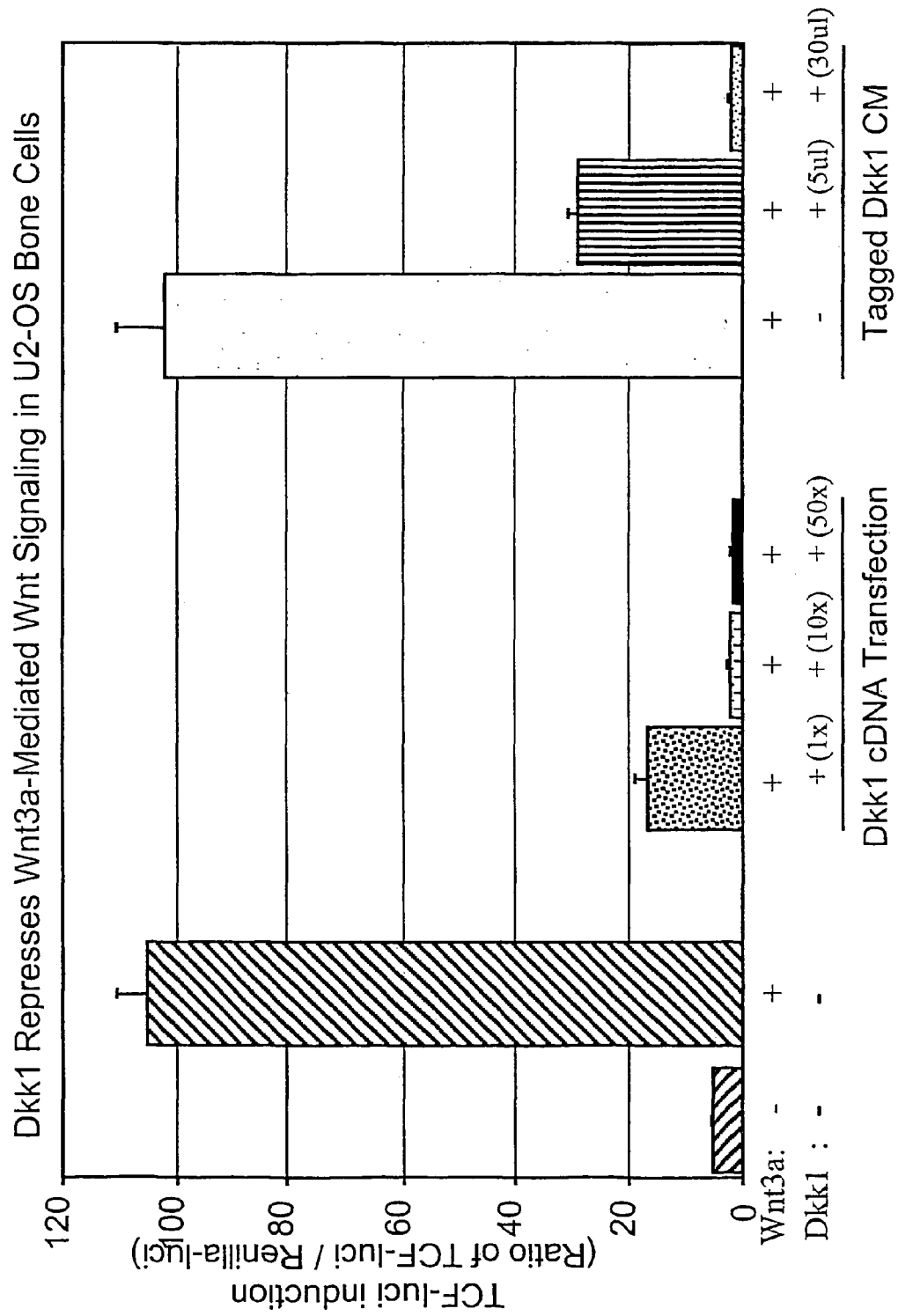
FIG. 45 shows that Dkk-1 represses Wnt3a-mediated Wnt signaling in U2OS bone cells using the cell-based reporter gene assay for high throughput screening.
Figure 46:
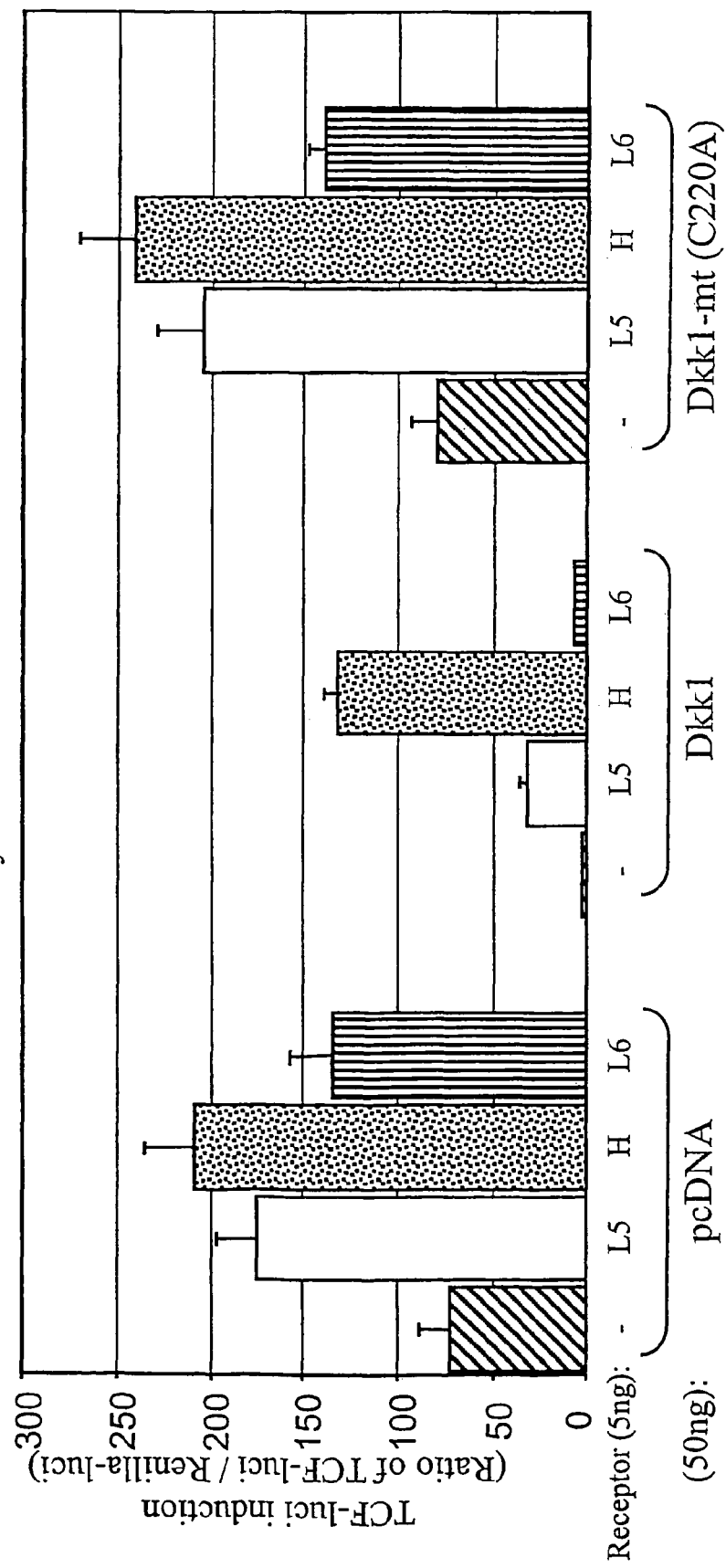
FIG. 46 demonstrates that Wnt1-HBM generated signaling is not efficiently inhibited by Dkk-1 in U2OS bone cells while LRP5 and LRP6-mediated signaling are using the cell-based reporter gene assay for high throughput screening.
Figure 47:
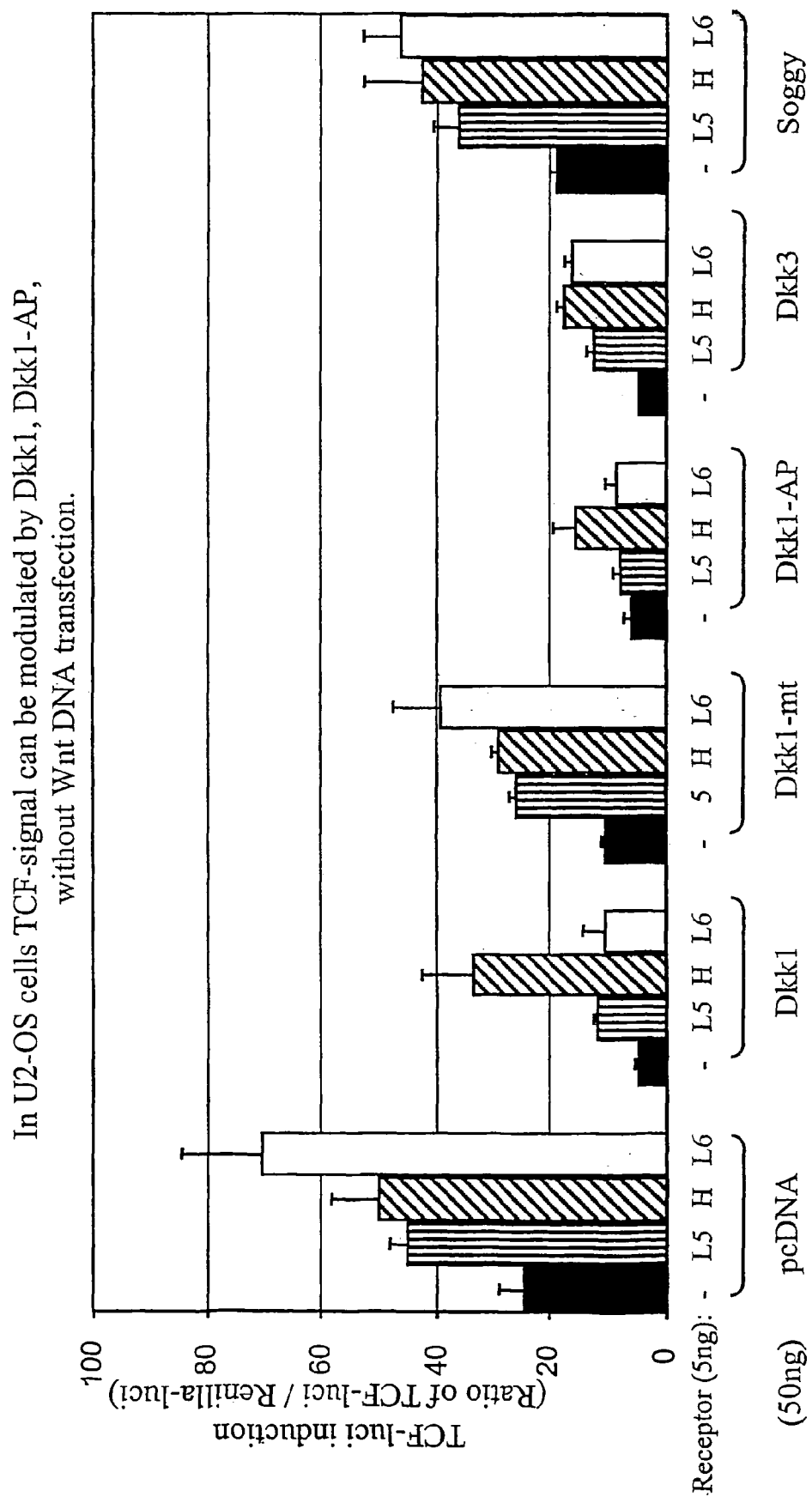
FIG. 47 shows that the TCF signal in the cell-based reporter gene assay for high throughput screening can be modulated by Dkk-1 and Dkk-1-AP without Wnt DNA transfection.

Using this system with a suppressed Wnt-TCF signal due to the presence of both Dkk and Wnt3a, one can screen for compounds that could alter Dkk modulation of Wnt signaling, by looking for compounds that activate or the TCF-luciferase reporter, and thereby relieve the Dkk-mediated repression of the Wnt pathway. Such compounds identified may potentially serve as HBM-mimetics and be useful, for example, as osteogenic therapeutics. Data generated from this high throughput screen are demonstrated in FIGS. 45–47. FIG. 45 shows that Dkk1 represses Wnt3a-mediated signaling in U2OS bone cells. FIG. 46 demonstrates the functional differences between LRP5, LRP6, and HBM. Dkk-1 represses LRP6 and LRP5 but has little or no effect on HBM-generated Wnt1 signaling in U2OS cells. FIG. 47 demonstrates the differential effects of various Dkk family members and modified Dkks, including Dkk-1, a mutated Dkk-1 (C220A), Dkk-1-AP (modified with alkaline phosphatase), Dkk-3, and Soggy.

Example 8

DKK/LRP5/6/HBM/HBM-like ELISA Assay

A further method to investigate Dkk binding to LRP or HBM and HBM like polypeptides is via ELISA assay. Two possible permutations of this assay are exemplified. LRP5 is immobilized to a solid surface, such as a tissue culture plate well. One skilled in the art will recognize that other supports such as a nylon or nitrocellulose membrane, a silicon chip, a glass slide, beads, etc. can be utilized. In this example, the form of LRP5 used is actually a fusion protein where the extracellular domain of LRP5 is fused to the Fc portion of human IgG. The LRP5-Fc fusion protein is produced in CHO cell extracts from stable cell lines. The LRP5-Fc fusion protein is immobilized on the solid surface via anti-human Fc antibody or by Protein-A or Protein G-coated plates, for example. The plate is then washed to remove any non-bound protein. Conditioned media containing secreted Dkk protein or secreted Dkk-epitope tagged protein (or purified Dkk or purified Dkk-epitope tagged protein) is incubated in the wells and binding of Dkk to LRP is investigated using antibodies to either Dkk or to an epitope tag. Dkk-V5 epitope tagged protein would be detected using an alkaline phosphatase tagged anti-V5 antibody.

Alternatively, the Dkk protein could be directly fused to a detection marker, such as alkaline phosphatase. Here the detection of the Dkk-LRP interaction can be directly investigated without subsequent antibody-based experiments. The bound Dkk is detected in an alkaline phosphatase assay. If the Dkk-alkaline phosphatase fusion protein is bound to the immobilized LRP5, alkaline phosphatase activity would be detected in a colorimetric readout. As a result, one can assay the ability of small molecule compounds to alter the binding of Dkk to LRP using this system. Compounds, when added with Dkk (or epitope-tagged Dkk) to each well of the plate, can be scored for their ability to modulate the interaction between Dkk and LRP based on the signal intensity of bound Dkk present in the well after a suitable incubation time and washing. The assay can be calibrated by doing cold competition experiments with unlabeled Dkk or with a second type of epitope-tagged Dkk. Any small molecule that is able to modulate the Dkk-LRP interaction may be a suitable therapeutic candidate, more preferably an osteogenic therapeutic candidate.

Example 9

Functional Evaluation of Peptide Aptamers in Xenopus

The constrained peptide aptamers constructs OST258-263 (where 258 contains the signal sequence by itself and 263 contains an irrelevant constrained peptide) (FIGS. 39 and 44) were used to generate RNA substantially as described in Example 6, except the vector was linearized by restriction endonuclease digestion and RNA was generated using T7 RNA polymerase.

Figure 49:
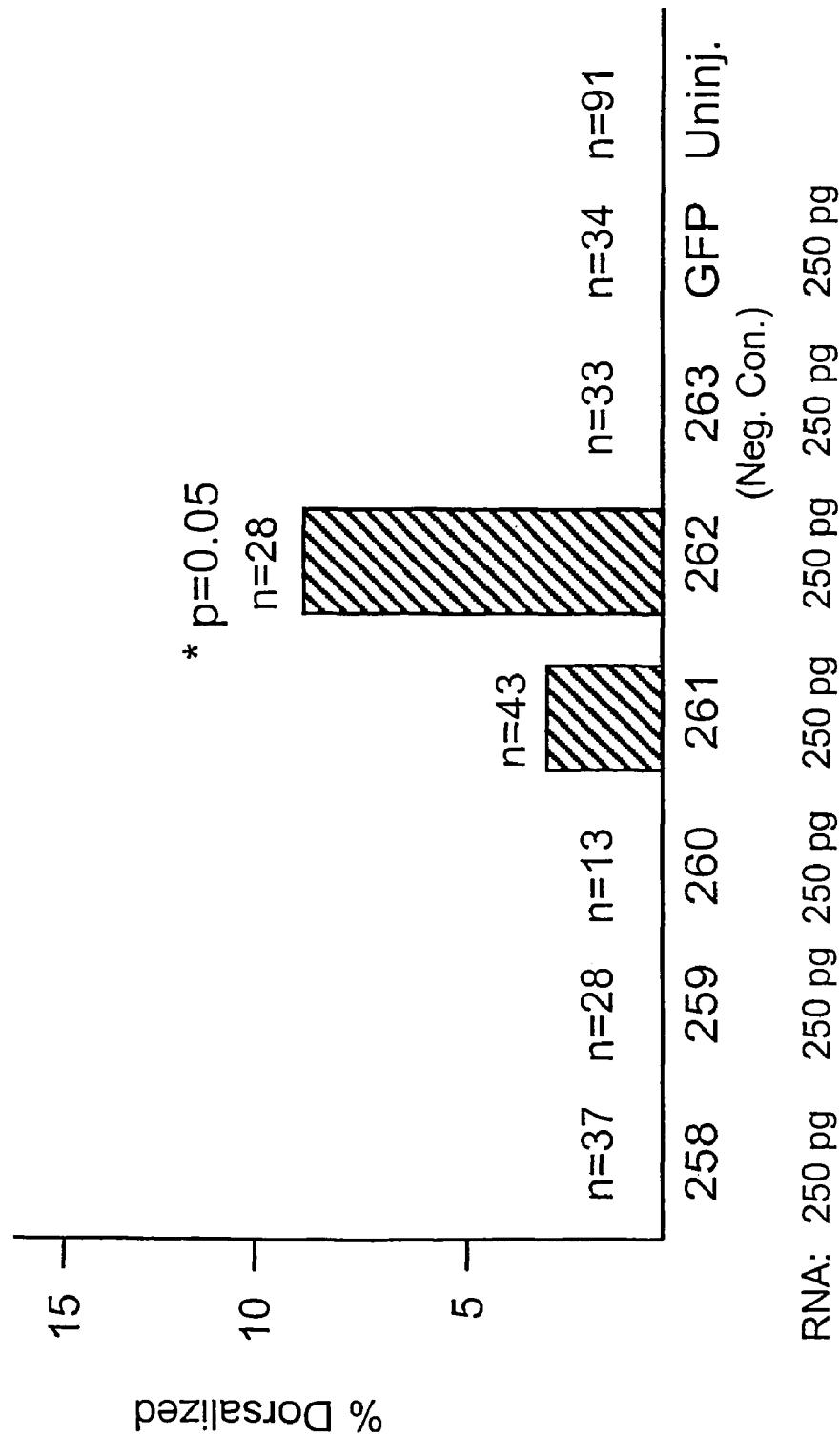
FIG. 49 demonstrates that LRP5-LBD aptamers 261 and 262 induce Wnt signaling over other LRP5 aptamers.

Aptamer RNA was injected at 250 pg per blastomere using the protocol of Example 6. Wnt signaling was activated, as visualized by embryo dorsalization (duplicated body axis) with aptamers 261 and, more strongly, 262. The results of this assay are shown in FIGS. 48 and 49. These results suggest that aptamers 261 and 262 are able to activate Wnt signaling possibly by binding to the LBD of LRP, thereby preventing the modulation of LRP-mediated signaling by Dkk.

The aptamers of the present invention can serve as HBM-mimetics. In the Xenopus system they are able to induce Wnt signaling all by themselves. They may also serve as tools for rational drug design by enhancing the understanding of how peptides are able to interact with LRP and modulate Wnt signaling at the specific amino acid level. Thus, one would be able to design small molecules to mimic their effects as therapeutics. In addition, the aptamers identified as positives in this assay may be used as therapeutic molecules themselves.

Example 10

Homogenous Assay

An excellent method to investigate perturbations in protein-protein interactions is via Fluorescence Resonance Energy Transfer (FRET). FRET is a quantum mechanical process where a fluorescent molecule, the donor, transfers energy to an acceptor chromophore molecule which is in close proximity. This system has been successfully used in the literature to characterize the intermolecular interactions between LRP5 and Axin (Mao et al., *Molec. Cell Biol.* 7: 801-9). There are many different fluorescent tags available for such studies and there are several ways to fluorescently tag the proteins of interest. For example, CFP (cyan fluorescent protein) and YFP (yellow fluorescent protein) can be used as donor and acceptor, respecively. Fusion proteins, with a donor and an acceptor, can be engineered, expressed, and purified.

For instance, purified LRP protein, or portions or domains thereof, fused to CFP and purified Dkk protein, or portions or domains thereof that interact with Dkk or LRP respectively, fused to YFP can be generated and purified using standard approaches. If LRP-CFP and Dkk-YFP are in close proximity, the transfer of energy from CFP to YFP will result in a reduction of CFP emission and an increase in YFP emission. Energy is supplied with an excitation wavelength of 450 nm and the energy transfer is recorded at emission wavelengths of 480 nm and 570 nm. The ratio of YFP emission to CFP emission provides a guage for changes in the interaction between LRP and Dkk. This system is amenable for screening small molecule compounds that may alter the Dkk-LRP protein-protein interaction. Compounds that disrupt the interaction would be identified by a decrease in the ratio of YFP emission to CFP emission. Such compounds that modulate the LRP-Dkk interaction would then be considered candidate HBM mimetic molecules. Further characterization of the compounds can be done using the TCF-luciferase or Xenopus embryo assays to elucidate the effects of the compounds on Wnt signaling.

While the above example describes a cell-fee, solution-phase assay using purified components, a similar cell-based assay could also be performed. For example, LRP-CFP fusion protein can be expressed in cells. The Dkk-YFP fusion protein then could be added to the cells either as purified protein or as conditioned media. The interaction of LRP and Dkk is then monitored as described above.

Example 11

Identification of Variants of LRP5/Zmax1/HBM.

Because the YWTD repeats (YWTD disclosed as SEQ ID NO: 1087) constitute the major part of domain which interacts with Dkk-1, a search was begun from the repeats to look for protein folds that contain such repeats. Springer, 1998 *J. Mol. Biol.* 283: 837-62 proposed that these YWTD repeats (YWTD disclosed as SEQ ID NO: 1087), which had been previously described as "spacers" and considered to have no defined structure, are in fact the propeller-blade subdomains of highly structured six-bladed β-propellers. Springer (1998) therefore proposed two theoretically modeled protein structures with such YWTD repeats (YWTD disclosed as SEQ ID NO: 1087).

Figure 50:
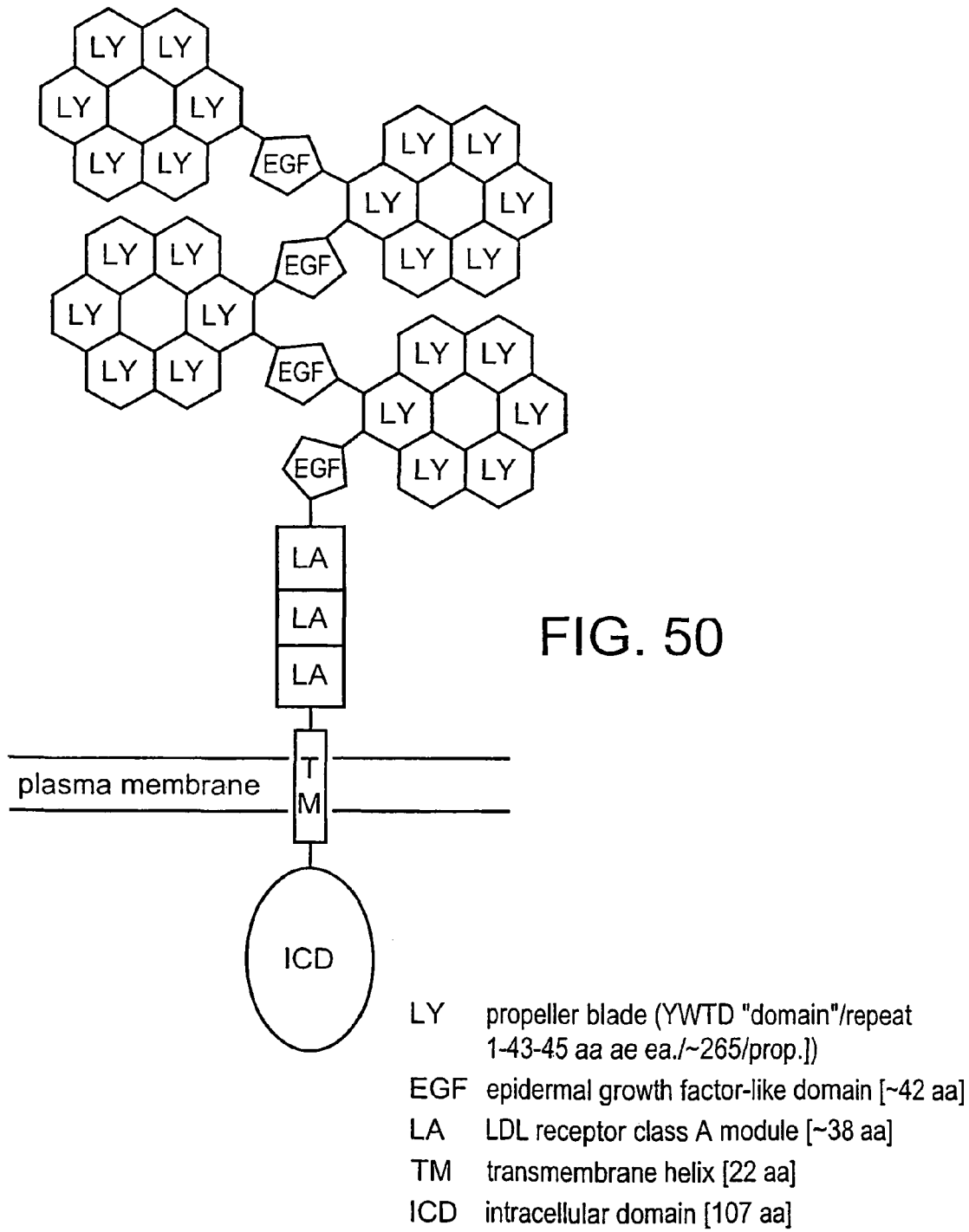
FIG. 50 depicts the LRP5 domain structure. The symbols are defined at the upper right. The structural domains are numbered successively from top to bottom corresponding to the N-terminal to C-terminal ends of the protein as Propeller 1, EGF-like Domain 1, Propeller 2, EGF-like Domain 2, and so forth. The structure was determined using the motifs and nomenclature described in Springer et al., 1998 *J. Mol. Biol.* 283: 837-62. YWTD disclosed as SEQ ID NO: 1087.
Figure 53A:
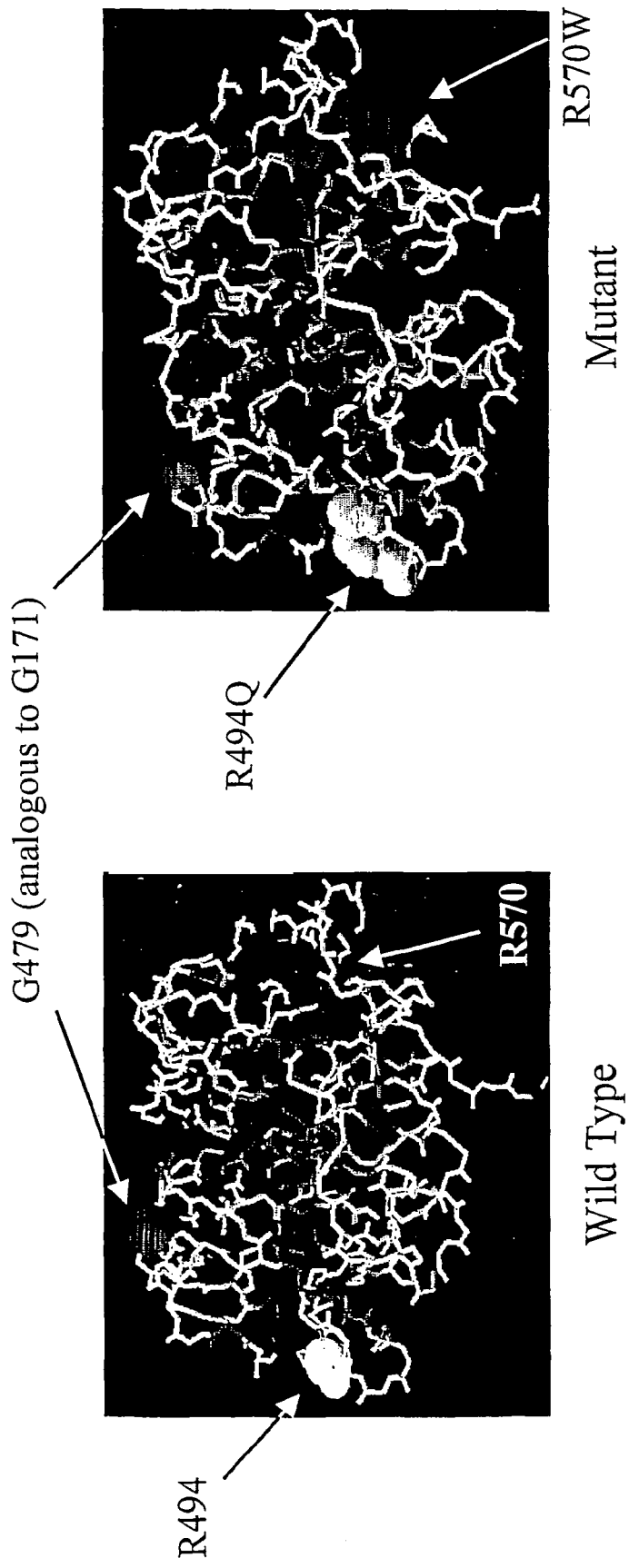
FIG. 53 displays the structural change due to the OPPG mutation versus the wild-type, Zmax1 (LRP5). Panel A depicts the homology model of LRP5's second propeller domain; Panel B depicts the third propeller domain and Panel C depicts the second propeller domain with two mutations.
Figure 53C:
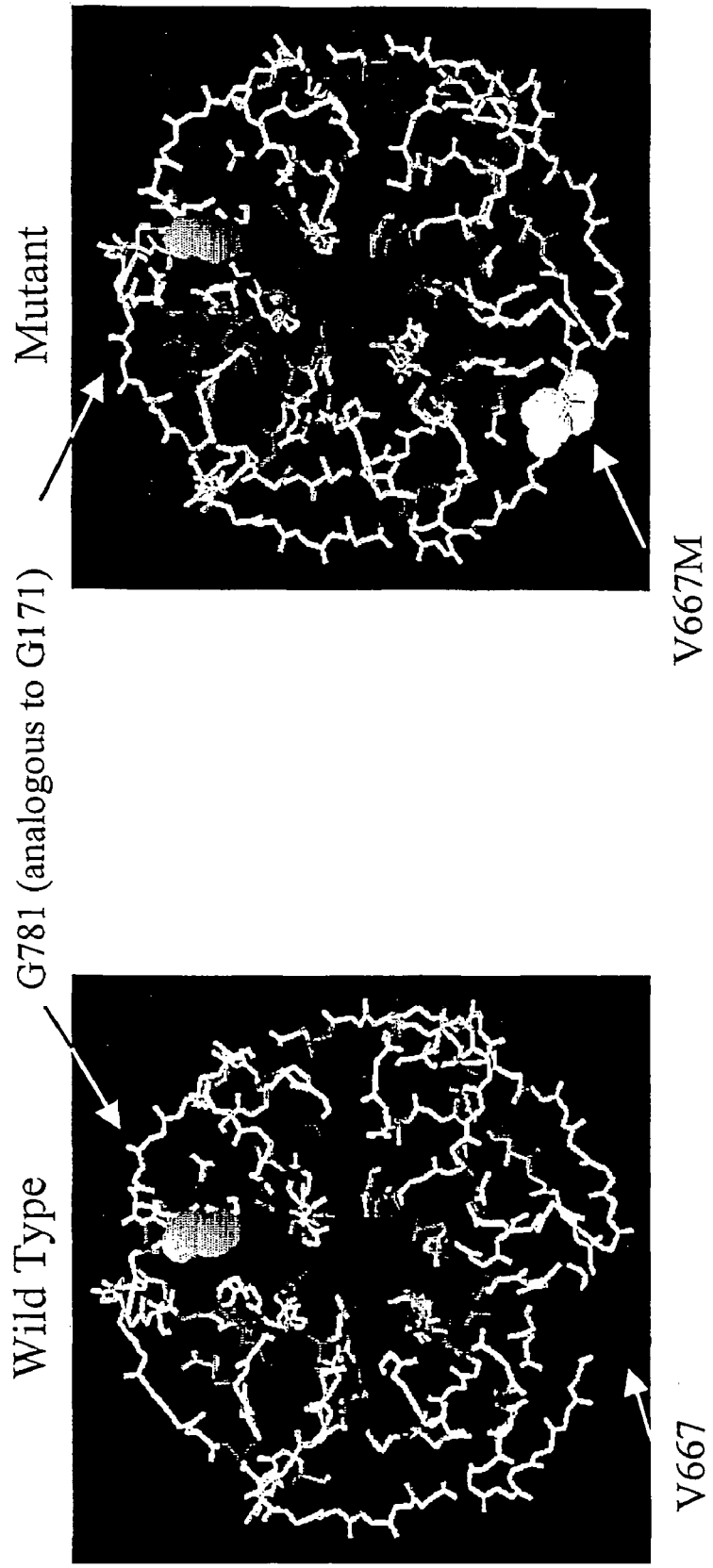

The Model. A set of LRP5 propeller domain sequences from mouse and human were assembled and aligned using CLUSTALW, together with the sequences corresponding to two of the modeled YWTD-propeller structures (YWTD disclosed as SEQ ID NO: 1087) of Springer (1998) [11 px, based on the LRP1β-propeller domain no. 7 from chicken (SwissProt LRP1_CH7), and mdx, based on human nidogen (Swiss-Prot NIDO_HU1)]. The alignment was manually edited based on the rationale and knowledge of protein structures. FIG. 50 depicts a schematic model of LRP5. The secondary structures consist exclusively of β-strands and turns. The secondary structure assignments were verified by the predictive program, DSC (Discrimination of Protein Secondary Structure Class available at the Institut Pasteur website). Preliminary checks of the exon-intron boundaries were performed manually. A tertiary-structure homology model for human LRP5 using the 1 Ipx model as a template was built with Insightil (Accelrys Inc., San Diego, Calif.) and examined using the graphics display programs from Insight II and Rasmol (freely available at the University of Massachusetts Amherst website).

Results. Based on the homology alignments and modeling, the domain diagram of LRP5 in FIG. 50 was obtained. FIG. 51 shows the complete alignment and secondary structure assignments for the propeller domains of mouse LRP5 and LRP6, human LRP5 and human LRP6, and the sequences corresponding to the two theoretical models constructed by Springer (1998).

To a good first approximation, the sequence alignments support the proposal that there are four 6-bladed β-propeller domains in human LRP5. This model nicely accommodates the sequence (as should be expected since it derives from a carefully constructed model of a chicken LRP propeller domain). The overall shape of this domain resembles a disk with inward-sloping sides and a hole down the middle. The polypeptide chain enters and leaves from the same (comparatively flat) "bottom" surface. As indicated in the alignment (FIG. 51) and in several of the structure illustrations, the G171V mutation falls into a loop on the outer or "top" face of the domain. This immediately suggests that—contrary to what one might expect, given the role of highly conserved glycine residues in determining protein folds—the mutation should not have any significant effect on the domain's tertiary structural stability. It is rather more likely that the mutation interferes with binding of some ligand, possibly a macromolecule (Smith et al., 1999 *Trends Biochem. Sci.* 24: 181-5) or alters a protein-protein interaction.

Closer scrutiny of the protein in the vicinity of G171 shows that this residue sits at the bottom of a pocket on the outer edge of the top surface of the domain. Moreover, one side of this pocket consists of a cluster of very hydrophobic side chains, while the other side has more polar groups, most notably glutamate 172. In the mutant form of the protein, with V171 in place of the glycine, the pocket largely disappears as the isopropyl group of valine replaces the hydrogen side chain of glycine. It is easy to understand how such a substitution could seriously disrupt ligand binding if the ligand normally protrudes into the pocket. By the same rationale, any other mutations that block such pockets in any of the four propellers could also result in impaired ligand binding.

The reasonableness of the proposed model is based on Springer's results as well as additional data. For example, data derived from the typical features of such protein domains (including the well-studied YWTD repeats (YWTD disclosed as SEQ ID NO: 1087)), e.g., that are robust and rigid tertiary structures. Loop conformations may vary somewhat, especially for the longer loops, but the basic features of the protein scaffold are almost certainly well predicted. Of course we would be on somewhat more secure ground if there were a crystal structure for one of these domains. That naturally implies that some of the more interesting features, such as the identity of residues exposed on the outer, putative ligand-binding surface, will also be well-predicted. Note that in FIG. 51 these residues are marked in red on the sequences corresponding to Springer's (1998) models. Even though different models could possibly be built that are not dependent on Springer's assumptions and lead to a different topology of the propeller, this would not alter the conclusion that the G171V mutation lies in a surface loop.

At the very least, the model affords an opportunity to think about this protein in molecular terms and that should facilitate both experimental design and evaluation of results, i.e., candidate epitopes might be selected more rationally. One interesting aspect, evoked forcefully by the diagram in FIG. 50, is the question of how the different modular propeller domains interact. The EGF-like domains are well-studied (dozens of crystal and NMIR structures exist, see for example Bork et al., 1996 *Quart. Rev. Biophys.* 29: 119-67). The EGF-like domains consist mainly of a couple of β-hairpins, cross-linked by disulfide bonds, and in some cases they have tightly bound calcium ions, which must further stabilize their structure. Interestingly, in contrast to the YWTD propellers (YWTD disclosed as SEQ ID NO: 1087), the EGF-like domains have the polypeptide chain entering at one end and exiting at the other. Thus, mechanically, these domains could act as spacers, even swivels (since rotation can occur around the tails that extend from either end). Given the size of the propellers, there are almost certainly inter-domain interactions between them as they assemble in some higher-order structure, connected by the EGF-like domains. Because of the topology of the propellers, their "top" faces would have to face outward since the EGF-like domains will tie them together by their protruding N- and C-terminal extensions.

A more sophisticated analysis of the β-propeller structure was modeled using X-ray crystallographic data from the LDL receptor. The primary amino acid sequences of the various beta propeller domains of LRP5 (and other domains) were used to develop homology models of their 3-dimensional structures according to the following method:

(A) Search for suitable structural templates and check sequence identity with target. The ExNRL-3D database which was obtained from the Protein Data Bank, was searched using BLASTP2 (Altschul et al., 1990 *J. Mol. Biol.* 215: 403-10; Huang et al., 1991 *Adv. Appl. Math.* 12: 337-67; and Peitsch, 1995 PDB Quart. Newsletter 72: 4) to find all similarities of the target sequence with sequences of known structure. This program selects all templates with sequence identities above 25% and projected model size greater than 20 residues. This step also detects domains that can be modeled based on unrelated templates. Use of this step resulted in the selection of Protein Data Bank (PDB) structure, 1IJQ ("Crystal Structure Of The LDL Receptor YWTD-EGF Domain Pair") (Jeon et al., 2001 *Nat. Struct. Biol.* 8: 499).

(B) Create ProModII (Altschul et al., 1990; Huang et al., 1991; and Peitsch, 1995) jobs and generate models with ProModII.

(C) Superimpose related 3D structures. This method is based upon the diagonals of sequence similarity (the Dynaminc sequence alignment algorithm (SIM)(Altschul et al., 1990; Huang et al., 1991; and Peitsch, 1995). Specifically, the following steps are performed:
(i) Primary match: Regions with sequence similarity are selected automatically (manual selection is also possible) and the corresponding residues matched in three-space. (ii) The primary match is further refined using expanding context spheres.

(D) Generate a multiple alignment comprising the sequences to be modeled.

(E) Generate a framework for the new sequence.

(F) Based on the topological arrangement of corresponding atoms: (a) atoms which occupy a similar portion of space and are expected to have a structural counterpart in the new structure are used to compute the framework coordinates (averaged positions); (b) Side chains with fully incorrect geometries are removed.

(G) Rebuild the lacking loops based on the geometry of the loop stems: (a) the stems of the loops to rebuild are used to scan a database of structural fragments derived from the Brookhaven Data Bank. Either the best fitting fragment or a framework derived from the five best fragments, is used as the new loop, or (b) the conformational space is searched using a CSP approach (seven allowed Φ-Ψ angle combinations, space allocation for the loop, space allocation for each α-carbon in the loop). Both methods will place only α-carbons when loops are in steric conflict with the surrounding context.

(H) Rebuilt incomplete backbones based on the position of the a-carbons, the backbone was rebuilt using a set of seven allowed Φ-Ψ angle combinations and a database of backbone fragments (a sliding window of five residues was run through the protein sequence. The best matching backbone fragment for each overlapping pentapeptide was then stored. A framework for the main chain atoms is derived from these peptides, using only the coordinates of the three central residues of each pentapeptide.

(I) The model's structural quality is verified and packing is checked as follows:
  (i) Verification of structural quality is based on the method described by R. Luthy et al., 1992 *Nature* 356: 83-85. This method analyzes the 3D context of each residue and allows the identification of mis-folded regions.
  (ii) Packing is checked based on a probe accessible surface (Connoly surface) computation and a cubic grid passed through the structure. Inside and outside surfaces are detected and the center and size of each cavity is computed. The algorithm then compares the size and distribution of these cavities between the model and the structure in order to detect possibly mis-folded regions.

(J) Refine structure by energy minimization and molecular dynamics based on force field computations following Gromos96 (*Methods for the evaluation of long-range electrostatic forces in computer simulations of molecular systems*, IN COMPUTER SIMULATION OF BIOMOLECULAR SYSTEMS, THEORETICAL AND EXPERIMENTAL APPLICATIONS, Vol. 2, 182-212 (W. F. van Gunsteren et al, eds., Escom Science Publishers, Leiden, The Netherlands, 1993); van Gunsteren et al., 1990 *Angew. Chem. Int. Ed. Engl.* 29: 992-1023; van Gunsteren et al., 1992 *Eur. J. Biochem.* 204: 947-961; Torda and W. F. van Gunsteren. *Molecular Modeling Using Nuclear Magnetic Resonance Data*, IN REVIEWS IN COMPUTATIONAL CHEMISTRY, Vol. III, 143-172 (K. B. Lipkowitz et al., eds., VCH Publishers, Inc. New York, 1992); van Gunsteren, *Molecular dynamics and stochastic dynamics simulation: A primer*. in COMPUTER SIMULATION OF BIOMOLECULAR SYSTEMS, THEORETICAL AND EXPERIMENTAL APPLICATIONS 3-36; van Gunsteren et al., *Computation of free energy in practice: choice of approximations and accuracy limiting factors*. IN COMPUTER SIMULATION OF BIOMOLECULAR SYSTEMS, THEORETICAL AND EXPERIMENTAL APPLICATIONS 315-348; Smith et al., Methods for the evaluation of long-range electrostatic forces in computer simulations of molecular systems, IN COMPUTER SIMULATION OF BIOMOLECULAR SYSTEMS, THEORETICAL AND EXPERIMENTAL APPLICATIONS 182-212; van Gunsteren et al., *Accounting for Molecular Mobility in Structure Determination Based on Nuclear Magnetic Resonance Spectroscopic and X-Ray Diffraction Data*, in Methods IN ENZYMOLOGY: NUCLEAR MAGNETIC RESONANCE, Vol. 239 619-654 (T. L. James et al., eds., Academic Press, New York, 1994); van Gunsteren et al., 1994 *Quart. Rev. Biophysics* 27: 435-481; van Gunsteren et al., 1995 *Biomolecular Modelling: Overview of Types of Methods to Search and Sample Conformational Space*, IN PROCEEDINGS OF THE 1ST EUROPEAN CONFERENCE ON COMPUTATIONAL CHEMISTRY, AMERICAN INSTIIITE OF PHYSICS CONF. PROC. 330: 253-268; and van Gunsteren et al., 1995 *Computer Phys. Communications* 91: 305-319).

(K) The structure is then manually refined based on sequence alignment and structural elements using Deep View, the SWISS-PDB Viewer (Guex et al., 1997 *Electrophoresis* 18: 2714-23).

Uses of structural model. Having a three-dimensional model of the protein domain allows one to appreciate the context of the HBM mutation, or other HBM-like mutations, in three dimensional space. This facilitates the prediction of possible mechanisms of action in a manner impossible in any other way because one cannot predict from primary sequence alone the proximity of one distant (in sequence space) amino acid to another. This also allows one to make functional predictions that can then be tested using molecular/cellular biology techniques to further refine the model and validate the target. For example, the structural model of the G171V mutation predicted an alteration in side chain-side chain interactions, so we were able to use this information to successfully predict similar mutations in other amino acids that would have analogous structural effects. Overlaying other functional data on this model would also able highlight other potentially important regions of the protein domain. Additionally, such models show the accessible residues, which would be useful for developing small compounds, antibodies and the like which recognize and bind to this region.

Results. Based on the space filling hypothesis set forth in Section 3 above, two residues from blade 6 of propeller 1 were identified as being in structurally equivalent locations to residue 171 in blade 4. Accordingly, substitutions with valine were engineered: F241V and A242V.

Residues that were predicted to be accessible to the interior surface of the propeller were identified in both blades 3 and 5 of Zmax1 (LRP5). Original predictions from the Springer model identified G199 on blade 5 and E128 on blade 3 as the equivalent position to residue 171 of blade 4 (HBM). Using the more sophisticated model described above, G199 and E128 are not predicted to be in the equivalent position to residue 171 of blade 4. Based on the new, more sophisticated model, the following residues were chosen for valine substitutions:

| Blade No. | Mutations |
|---|---|
| 5 | L200V, T201V and I202V |
| 3 | S127V |

Another residue T125 was selected for a conservative substitution with T125S as well as a less conservative substitution of T125G.

The role of the YWTD repetitive motifs (YWTD disclosed as SEQ ID NO: 1087) in the β-propeller was examined by carrying out an alanine replacement scan over this region in Blade 4. These repeats are predicted to create the β-sheet blades of the propeller. Based on this model data, the following additional mutations were prepared in propeller 1:

Y164A, M165A, Y166A, W167A, T168A, and D169A. These substitutions would be predicted to be detrimental to the β-propeller structure.

The spacing filling or occupied space model was further examined by mutating a residue predicted by the above methods to reside on the exterior surface of propellar 1, blade 4. This mutation, K215V (K→V at position 215), was selected because it was believed to not produce an HBM-like effect.

Based on this information, the following model of the HBM G171V mutation was obtained. Specifically, substitutions of valine at specific locations within propeller 1 could result in the creation of hydrophobic patches on the surface of the propeller. For example, the V at residue 171 of the HBM mutant comes in close proximity to L150 on the adjacent strand, potentially creating a hydrophobic patch that was not present with the wild type G171. An example of this prediction, and others are presented in a separate file (FIG. 52).

Based on this model, a mutation of L150G which would remove the hydrophobic side chain at this site may not produce an HBM effect. In addition, a double mutant of G171V (HBM) and L150G may not produce an HBM effect due to the elimination of the hydrophobic side chain interactions. The model can also be used to test this prediction on a different propeller 1 blade. The substitution A214V was shown to result in an HBM effect. I194 is the residue that is in the equivalent position to A214 on blade 5 as L150 is to G171 on. blade 4. While the mutation of 194G alone may not be predicted to result an HBM effect, the double mutant of I194G and A214V may no longer permit a hydrophobic patch to form and as a result not generate the HBM effect observed with A214V. Additional analyses of the residues in proximity to A214 that may contribute to the formation of hydrophobic patches identified P240 and F241. Mutations of either P240G or F241G together with A214V may no longer permit the formation of hydrophobic patches and may eliminate the HBM effect observed with A214V alone.

Lastly, the new model was used to investigate specific aspects of the other three propellers. The relevance of residues R494, R570 and V667 in the three other propellars was investigated. These three residues were chosen since they have been reported to be the site of osteoporosis pseudoglioma disease causing missense mutations: R494Q, R570W and V667M (Gong et al., 2001 *Cell* 107: 513-523). Based on the structural location of these residues on the outer surface of the propeller, the model would not predict that these substitutions are either gain- or loss-of-function substitutions (FIGS. 53A-C). For example, the mutations, related to osteoporosis-pseudoglioma syndrome (OPPG) result in patients having very low bone mass and who are prone to developing fractures and deformation. This genetic condition is known now to result from mutations in LRP5 (Gong et al, 2001 *Cell* 107: 513-23). Based on this information, this mutation would be categorized as a loss in function mutation.

As a result, we have engineered these receptor variant to functionally test. These new receptor variants were generated exactly as described above with the following oligonucleotides (SEQ ID NOS 968-1007, respectively, in order of appearance):

```
L150GF
GAAGGTGCTCTTCTGGCAGGACGGTGACCAGCCGAGGGCC

L150GR
GGCCCTCGGCTGGTCACCGTCCTGCCAGAAGAGCACCTTC
```

-continued

```
I194GF
GATCATTGTGGACTCGGACGGTTACTGGCCCAATGGACTG

I194GR
CAGTCCATTGGGCCAGTAACCGTCCGAGTCCACAATGATC

L200VF
CATTTACTGGCCCAATGGAGTGACCATCGACCTGGAGGAGCAGAAGC

L200VR
GCTTCTGCTCCTCCAGGTCGATGGTCACTCCATTGGGCCAGTAAATG

T201VF
CATTTACTGGCCCAATGGACTGGTCATCGACCTGGAGGAGCAGAAGC

T201VR
GCTTCTGCTCCTCCAGGTCGATGACCAGTCCATTGGGCCAGTAAATG

I202VF
CATTTACTGGCCCAATGGACTGACCGTCGACCTGGAGGAGCAGAAGC

I202VR
GCTTCTGCTCCTCCAGGTCGACGGTCAGTCCATTGGGCCAGTAAATG

T125SF
GGCAAGAAGCTGTACTGGTCGGACTCAGAGACCAACCGCATC

T125SR
GATGCGGTTGGTCTCTGAGTCCGACCAGTACAGCTTCTTGCC

T125GF
GGCAAGAAGCTGTACTGGGGGGACTCAGAGACCAACCGCATC

T125GR
GATGCGGTTGGTCTCTGAGTCCCCCCAGTACAGCTTCTTGCC

S127VF
GAAGCTGTACTGGACGGACGTAGAGACCAACCGCATCGAGGTG

S127VR
CACCTCGATGCGGTTGGTCTCTACGTCCGTCCAGTACAGCTTC

F241VF
CCTGACGCACCCCGTCGCCCTGACGCTCTCCGGGGACACTC

F241VR
GAGTGTCCCCGGAGAGCGTCAGGGCGACGGGGTGCGTCAGG

A242VF
CCTGACGCACCCCTTCGTCCTGACGCTCTCCGGGGACACTC

A242VR
GAGTGTCCCCGGAGAGCGTCAGGACGAAGGGGTGCGTCAGG

K215VF
CTACTGGGCTGACGCCGTGCTCAGCTTCATCCACCGTGCC

K215VR
GGCACGGTGGATGAAGCTGAGCACGGCGTCAGCCCAGTAG

Y164AF
CTTGGACCCCGCTCACGGGGCCATGTACTGGACAGACTGG

Y164AR
CCAGTCTGTCCAGTACATGGCCCCGTGAGCGGGGTCCAAG

M165AF
GGACCCCGCTCACGGGTACGCGTACTGGACAGACTGGGGTG

M165AR
CACCCCAGTCTGTCCAGTACGCGTACCCGTGAGCGGGGTCC

Y166AF
CCCGCTCACGGGTACATGGCCTGGACAGACTGGGGTGAGAC

Y166AR
GTCTCACCCCAGTCTGTCCAGGCCATGTACCCGTGAGCGGG
```

-continued

```
W167AF
CGCTCACGGGTACATGTACGCGACAGACTGGGGTGAGACGC

W167AR
GCGTCTCACCCCAGTCTGTCGCGTACATGTACCCGTGAGCG

T168AF
GCTCACGGGTACATGTACTGGGCAGACTGGGGTGAGACGCC

T168AR
GGCGTCTCACCCCAGTCTGCCCAGTACATGTACCCGTGAGC

D169AF
CACGGGTACATGTACTGGACAGCCTGGGGTGAGACGCCCCG

D169AR
CGGGGCGTCTCACCCCAGGCTGTCCAGTACATGTACCCGTG

R494QF
CAACTTGGATGGGCAGGAGCAGCGTGTGCTGGTCAATGCCTC

R490QR
GAGGCATTGACCAGCACACGCTGCTCCTGCCCATCCAAGTTG

R570WF
GCAGCGCCGCAGCATCGAGTGGGTGCACAAGGTCAAGGCCAG

R570WR
CTGGCCTTGACCTTGTGCACCCACTCGATGCTGCGGCGCTGC

V667MF
CGAGACCAATAACAACGACATGGCCATCCCGCTCACGGGCG

V667MR
CGCCCGTGAGCGGGATGGCCATGTCGTTGTTATTGGTCTCG
```

Point mutations in other molecules with beta-propellers have been described in the literature. For example, alpha4-integrin (Guerrero-Esteo et al., 1998 *FEBS Letter* 429: 123-8) has had two mutations introduced, which resulted in altered protein function (i.e., G130R and G190S). Both of these glycines are in structurally equivalent locations to G171 of LRP5, just located on different blades of the beta-propeller at the upper surface. Using the model discussed above, we mapped these residues of the alpha4-integrin and confirmed their placement. The result of these substitutions in the alpha4 integrin was loss of ligand binding and reduced affinity to its heterodimer binding partner: integrin-beta1, such that the alpha4-beta1 ($\alpha 4\beta 1$) heterodimer cannot be formed. Examples of modulation of other residues in integrin-alpha4 with functional consequences are referenced within Guerrero-Esteo et al. (1998). Thus, these data support the notion that disruption of beta-propeller structure can result in significant and dramatic effects on receptor function;

All references cited are herein incorporated by reference in their entirety for all purposes. The following applications are also incorporated by reference in their entirety herein: U.S. application Ser. Nos. 09/543,771 and 09/544,398 filed on Apr. 5, 2000, which are a continuation-in-part of application Ser. No. 09/229,319, filed Jan. 13, 1999, which claims benefit of U.S. Provisional Application No. 60/071,449, filed Jan. 13, 1998, and U.S. Provisional Application No. 60/105,511, filed Oct. 23, 1998. Additionally This application claims priority of Application Nos. 60/290,071 filed May 11, 2001; 60/291,311 filed May 17, 2001; 60/353,058 filed Feb. 1, 2002, and 60/361,293 filed Mar. 4, 2002 the texts of which are herein incorporated by reference in their entirety for all purposes.

SEQUENCE LISTING (1111 sequences)

SEQ ID NO: 1 - DNA, 5120 bp, Homo sapiens
  CDS (71)..(4915)
actaaagcgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggtggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaaca

SEQ ID NO: 2 - DNA, 5120 bp, Homo sapiens
  CDS (71)..(4915)
actaaagcgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactgggttgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggtggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaaca

SEQ ID NO: 3 - protein, 1615 aa, Homo sapiens [sequence omitted]

SEQ ID NO: 4 - protein, 1615 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWVETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEVDCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 5 - DNA, 3096 bp, Homo sapiens
catcttctcacacgatctctcgcttcgcactccttcctttgattggttttcaccatttactcagacgacggtccttcttcgatctttgcacattcttctatcatctactaccttcatacccagctccgtcccctaatattcatgcgcggatggcccattccgtggtgaaaattcccttctactctgctaatctgctgttctctctccctcccgtcgggttctgctcctgccacgttctcccctctccccaccaaaggctgggttttctttgtcagggctcctttcccctttggaagaaggggggctgtatggccttggtgcgaggccctccagtgacaggatcccccatcacccagagttccacaggccctggtagggaggagggggagcagaagaggaggtgccatctttgcctgctggggaagggcaggggccacccacacagagctctcccatttgctgtggaccctggggccactgcccagttccttccaaaggaaagccagctccccaggtggtgggagagtgatatggcttcctcttaaacttagggaattgagtgtgtggttgcttctaagtgccttagaagccgggagcggctcctggaaagagcctgcctgccacagcgggccttaccctggctgtgcccacagatgtccctggggcctgccgctcctgcccggctctcctggcctcccccggtgtgggttgggaaaagcacagcaaattaaaaaacacctccatctctggcctttgaagaatgcatctgaacagccgagagtgtaaaccgtggtgaaatgtggtctttccagtttggggagaagcagggcagagctggggcttttgtacccagggtttccaagagctcctgcctccctcggctgggctggccagggccccccgctgggacctccagctgtaatagggaaggttttactgggttgctggccactgtggactgcccctaagggcaggtatgcctgcctttacccgggttcccctcctgcctggaagatacagcccatgggaggcctgttgtctgtgggatcctccagcatcagagacactggggccagcgtctgcctggtgaggtgcaggcctggcaggcccggtcccccacctgcttgagcacccacggtggtgggggctcgctgcctcccgagacaatctatgtcattgttgtccaaggaagctaatttagagtagaaagttccgtgtccagtcccactctgtgcgtgtgttagcaggggactctcgggccggagctgggtccaccctggtagggggacttcatggggcctgggcgacagcactgtgtatttgtgtgtgtgtgtgtttgtgtgtgtgtgtgtctgaggaggtggaccagtttctcaaaaggcctgtgaccccaagaaccaaggaatttcagcctgggtggatcacaccttcactggtgagtgggacaagctgggggccctcgccacaggagcagccagggcatggggcacagttggcctcattcacaaaatgggagtataagtgatccctgctctggcggccaggacgatgagtgggaacacaccgtgtgggggctgcctggcctgggtgtgccgcgggtgtccttgttggtgatggttccacctgcttgtgccaccagtgccctctgggtctcacacacaactctcttcccagcgaaggcccctcctgccctcaggcctcagtgctgcttccgtctcggaaggccccaggagctcctgcatcctgggcgtgattcctgtgtgcctgcagaccccctcgcggctgccatctcatcctttggtgcacctgttggccagacctcctggtagcgggtgctgcactcccctgaatgtgccggggcctgggggcagggacctgggctcctccctcactgagtggagggaactcagtgtcttggagttggggtgcctgcaggctgggtggtgcaggtgaaatgcagacctctcagctggtgttccagagcagctgccttcccccgcccgagggacttcacccgcagcccagtcaggggtggcgcctgggtgcatcgcccgcaggctgggtaggggtggagcctgggtggccctgcctgtgagctgcatagttgtcgcctttgaccctgagttttcttcgttatctgtttggacctgtttggggcaggcaggggatgagatctgaagataaatgccttagctgtgaccatctccttttgtgagaggtcaatgtccagttccgctgcagttataacatcccattttttgatttctttttattttttcctttttctttttgagatggagtctcgctctgtcacccaggctggagtgcaatggggtgacctcagctcactgcaacctccacttctcgggttcaagtgattctcctgcctcagcctcctgactagcaggggttacaggcgtgagccaccacgcccagctaatttttgtatttttagtagaggcaaggtttcgtcatgttggccaggctggtctcaaactcctggccttaagtgatctgcccgcctcggcctcccaaagtgctgagatgacaggtgtgagccaccgtgcccggcccagaactctttaattcccacctgaaacttgccgccttaagcaggtccccagtctccctcccctagtccctggtcccaccattctgctttctgtctcaatgaatttgcctaccgtaagtacctcatataaattgaatcataaagtatttgtctttttatatctggcttatttcacttagcataacattcttaagtttcatccatgttgtagcatgtgtcagaatctctctctttttttttttttttttttttttttttttttgcagacagagtctcgctctgtcatctagactggagttcagtggcacgatctcggttcactgcaacatctgcctcctgggtccaagcaattctcctgcctcagcctccttagcagctggaactacaggcgcgtgccaccatgccttgctaatttttgtatttttatgtggaggcagggtttcaccatcttggccaggctggtctcgaattcctggtcttcaccacgggggcccgaaggacccgggcaaagcgtggaggggagg

SEQ ID NO: 6 - DNA, 26928 bp, Homo sapiens
  modified_base (12044)..(12044): a, c, g, t, unknown or other
  modified_base (12489)..(12489): a, c, g, t, unknown or other
  modified_base (26433)..(26436): a, c, g, t, unknown or other
  modified_base (26439)..(26439): a, c, g, t, unknown or other
  modified_base (26441)..(26441): a, c, g, t, unknown or other
gaagaccaagggcacacagcgaggcagtttcagggcgggcagcctggggccccacggggcggccccggacacttgttctcacctgtggagggcagagaagggaacagggagagaagtggccggctgggagtggaggtgggtttgaggttttactgtaaactaaatgtgtaccctctaccttagttatgaattatgagacacgaagactgcgaaacagacacactcctctaaaagtgcctctaggctgacagggagaaagtcccgccaggctcccagacgccacctttgagtccttcaacaagcccgccagggcctcttgcccaccggtgtcagctcagccactgaaccctccaggaagaagacgtgctggtaggagaagaatctcacccaggcacagcctggaaggggcacagaaggggctccggaaccagcaagcccaagttggaactcccagtctgctactttctagaacgactgtgcccttggcgggtctaagtagaacctctccgcgcactctttcctcctttgtaaagtggggacagcaatggccaccttgcaggttcagagagggcttgcagtacctcacagaactgagtgcccgtgaacgtgtgtgttcctccagatttgtgacagctttgccaggctggagtcaggctgaacgcctctgccctcatggggtttatattctaggaagaccaacaaaaacaagaagacggaaaattaaaacaacaaaagccccattgacaggccgtgaagaatgccatgaaaaatgaatggcgttgtgctgcagtctttggggaaacgggcttacggaaagaaggacacttgagctgctaccaatgagcagccgtccggtgggagggcagttcaggaagagcagacatccactgaggaggcgctggggcagagggcagcctggtcgctggattcgggggaggaaccacatcaggccatgagctggagctggtggtagaatgtacaggagaggccagccagggccagctcatgtcagacctcaagcggggaagatgaatcgagaatgcaccccacgagcaatgggaagccagtctacgatttaagcagcaaaaatattttcccttcttccaccctgcatccagctctaccagcacagcctggggttctattttcaagatagaatagacccagactcccagctcttcttacacttctactactgccacctgtcacccactcatgcgtccccacttgcagcctcgacccccttccacctgatctcatggcagccagggaagctccagggctcgtgagggctgccatctcaggaaagaagcaaaagccttcggcacctgcagggcctgctccaaccacacttcttccttgacctctcagcttccttagccactcccttcccacatctcaccctgctccagccacagtggtgtctctgtgggttctcaaacacaccaggtgcactcctgcctcagggcctttgtgcttgctgttctctgctgggactcttttttttttttttttttttgagacagggtctcactctgtggcccaggctggagtgtagtggtgtgatcgtagctcattgcaacctcaaactcctgggctcaagcaatcctcccacctcagcctctcaagtagttagcttttgttgttttgttttgagatgggatctcactctgttgcccaggctggagtgcagtggggcaatcttggctcaccacaacctctgcctcccaggctcaagcaattctcctgcctcagcctcccaagtagctgggattacaggcatgtgccaccacgcccagcttatttttgtatttttagtagagacagggtttcaccatgttggtctggctggtcttgaactcctggcctcagatgatccacctgcctcggcctcccaaagtgctgggatgacaggcatgagcctgtctctagtagttaggactacagagaggggccatcatgcctggtgatcctcccaccttttctgctccaactctttcaccccacttagcctcgtggctcactctcttacctcttcagctcctcagtcaggcctgaggacccctgttgaaaattgcaaaccacaccccccaccaccaccacccactattgccagcactttctactccatttctctgctttacttttctcctttgtactcatcaccacctgactcattacatgtttacgtatctttcttctctccactagcatggaagctccaggagagcagagagtgtagttttattccctgatgtgtttcctgtgcccgtaccagggcctagcacacagtaggtgctcagtaaatgtgtgttggatgaacaaatacagtgaaaggatctgatctacatttataaagaaggcactctggctgctgagtggggatgagactgtcaggaggaaagaggcccctgtgggggcctggccagcaggtgggtacaatggtagcagccaggagagagggcctcttggactcaagtggatggggcctgctcagggctccggccacaggaacaaagggaagggggcccaggatggcctgtcatagaggacacattacaactggcccaaagttcaagtcaggtttctaaatttgggaagggatacagaaaaactaaagactctactggacagtcagttattgaaatgattacatagaaaatgtaccaagaattaaaaaaaaaaaaaaaaagcattatgaaggggccaccagagactcccagagaggaaagggactatgggctggatgcggtgactcacacctataatcccagcactttgggaggccgaggagggtggatcacgaggtcaggagttcaaaaccagcctaggcaacatggtaaaacccccgtttctactaaaaatacaaaaaattagctgggcatggcagcatgtgcctgtaatcccagctactcgggaggctgaggcaggagagttgctagaacccaggaggcagaggttgcagtgagccgagattgagccactatgctccagcttgggcgacagagcaagactccgtctctaaaaaaaagaaaaaaaaggccagatgaggtggctcatgcctgtaatcccagcactttgggaggccgaggtgggtggatcacgaggtcaggagatcgagaccatcctggctaacatggtgaaactccatctctacttaaaatacaaaaaattagccgggcgtggtggcgggcacctgtagtcccagctacttgggaggctgaggcaggagaatggcgtgaacctgggaggcggagcttgcagtgagccgagattgcgccactgcactccatccagcctgggcgacagagttagactccgtctcaaaaaaaaaaaaaaaaaaaaaattagctgattagttgggcttggtggcgggcgcctgtaatcccaactactcgggaggctgaggcgggagaatcacttgaacccgggaggcagaggttgcaatgagccgatatcacgccactacactccagcctgggcgacagagcaagactccatctcaaaaaagaaaaaaaaaaagaaaggggctgtgctgtggcctgggacccaaagcacactactgcaaggtcccagggtgcctgactccaaccggagccttgagaacattcatttgcaaagaatgaattaaaattcagcactattttattctgcaggattccagcaccccaaggacagtcatttttagacccttcagtaacgtaataagtaaccggaggatgtgctgagcttccacttccccagacggttgcctgtcacagctcatcaggccaacaaacttttcttaggcctcaaatttggaaatgttcactctcagttcgttccttagatgcaagtccatcccaatgaagtaacaggggctcagcacctgtccaatctcattgcttccggggacaggggcccatgaggatgtcgtttcagcccggtgacacttgggcaaagtgccttttggtttccctcccaggctggaacgtgctggctctgtgaagttacgctgggcacaagagccccccccaacccggcaggactgactgctgtggtcagaggcgcccctggggctttgggagccacagaatcttcctgagggcagcgccggaggaggccccagtgagagtgcccactgccaggctcattcctcaggctgccgcaggcctctccccaaaacaggcaatgcttctcagcaacctgccccaggagcaggccagggaaggccgccatcggcctacagtgctgggctctggagggcttggttggtaacaggccatggtttctatgagccagctggggtgtgaaggacacaggctggattcacctctctgggcctcagtttctgcattcaaaaagtgggaatcatgatatctgctctatttcttatctctcagtgctgatgtgaacctccaataagacttttaaaaatactctttctaccttacttttatttttcatttattttaagataatgtctagctgtctcacccaggctggagtgcagtggtgtgattacggctcactacagccttaacctcccaggctcaagtgatcctcctaccacagcctcccaagtagctggaactacaggcatgcaccaccgcacctggataattttttcttttgagacaaggtttcactctgttgcccaggctggagtgcagtggtgcactcttggctcactgcagcctcaacctccctgggcttaggtgatcctcacacttcagtctcccaagtagctgggactacaggtatgtgccagtacacccagctaatatttttgaaggatggggtttcactatattgcccaggctggtcttgaactccagggtttaagcaatctaccttcctcagcctgccaaagtgctaggattataggtatgagccaccccccggcctataatcctaccactttaaaaaagcctgtaattttagcactttaaaaaatttttctaaattttttatagagatgggggacagctgtggtctcactgtgttgcccaggctggtcttgaactcctaggatcaagccatcctcctggcctggcctcccaaagtgttgggattataagcataagccttaccttaccttttttttttgagttgcagttttgttcttgttgctcaggctggagtgcaatggcaagatcttggctcactgcaacctccacctcccgggttcaagcaattctcctgcctcagcctcccgagtagctgggattacaggcatgcgccaccacacccagctaattttgtatttttagtagagatggggtttctctatataccttaattttaaagcactgcattcatgtaaattgtgattaacatggattcaagagagggagtgaggatgaatgagccaggcagtcacctcggctgtcaccctccacttctctcctccttctgacagtcatcgtccatccgtttctgcagctgtttgtttgactctcctgatcattttgcttgccacataacttgcctcctgggaaagaatgccctgggcaggcccacatgagtagtgaaaaataatctgcagtgaaaaataaaactaagtagtctggtccacagagcagtcttattttttcactgcagatgaaggagttgacattcaggcttcattctcatttataagtgttttaaagacacatacagtggattgaacagtggccttcaaaaagatgtatctacatcctaatccctgggacctgtgaatgttaaccaagttaggaaaagggtcttcccgggtgtcattaagttagagatcttgagatgaggagctcatcgtggattatccaggtggaccctgcatccaaggacaaatggtccttagaaaagaaaagcagaggctgggcacagtggctcaagcctgtaatcccagcactttgagaggccgaggtgggtggatcacctaaggtcatgagttcgagagcagcctggccaacatgatgaaatcccatctctactaaaaatacaaaaattagcaaggcatggtggcgggtgcctataatcccagctactcaggaagctgaggcaggagaatggcttgcacctgggaggcggaggttgcagtgagccaagatcgcgccactgcactccagcctgagggagaaaagtgaaactctgtctcataaaagaaaagaaaagcagacagagatctgagacagaagaggagagtgaaggaaaaaaggccatgtgaagatgaggcagaggttggagccatgcagccacaagccaaggaatacctggagccccagaagttgcaagaggtaggaagaagcctcccctagagcctccagacggagcacagccctgccaacacctccacctcagacttctggcctccagcactgtgagataatcaactgctgttgttttaagccaccagatttgtggtaatttgttatggcagccacaggaaactaatacagtacctaatcttcacaaacccatcttacagaaaaggaaactgaagtcagagaggtagtggcttgtgcagtgtgttaggccattcttgtattactataaagaaatacctgaggccgggcatggtggctcacgcctgtaatcccagcactttgggaggccaaggtgagtggatcacttgaggtcaggagttcaagaccagcctggacaacatggtgaaaccccatttctactgaaaatatgaaaattagccaggcatggtggcgtgcatctgtagtcccagctactcaggaggctgaggcaggagaatcacttgcgcccgggaggaggaggttgtagtgagccaagattgtgccactgcactccagcctgggagacaagagagaaaccctgtctcaaaataaataaaaaacaaataaacacctgagactgggtagtttataaagaaaggggttaactggctcccggttctgcaggctgtacaagcatggtgccggcatctgcttggttgctgggaaggcttcagggagttttactcatcgtggaaggcagagccagagcaggtgcatcacacagcaaaagcaggagcgagagagagagagagcagggaggtgtgcacacttttaaatgagcagatctcacgagaactcaccattgcaaggacagcaccaagccacgaggggtctgcccccatgacccaaacctcccactaggccccacccccaacattgggaattacagttcaacatgaggtttggggggacaaatatccaaactatatcattccacccctggccccccagatctcatgttcttctcacattgcaaaatatagtcatgccttcccagtagccccccaaagtcttaactcatcccagcattaactcaaaaatcccattcccaagtccaacgtctcatctgaagatgagttcctttcacctacaagactgtaaaaatgaaaacagttatttactgctgagatacaatgggggcataggcattaggtaaacattcctgttccaaaagggagaaatcggtcaaaagaaaggggctataggccccaagcaagtccaaaacccagcagagcaatcattcaatcttaaagctccaaaataacctccttaaactccatgtcccatagccagggcacactggtgcaaggggcaggctcccaaggccttgggcagctctattcctgcggctttgcagaattcagtccccatggctgctcttacagattggagatgagggcctgcggcttttccaggtgcagggtgcaagctgctggtgatctaccattctggggtgtggatggtggcggccccgtcccgcagctccactaggcattgtcccagtggggactctatgtggggcctccaaccccacatttcccctccaatgggaaggctctgcccctgcagcagccttcttcctgggctcccaggctttctcatacatcctctgacatctaggtggatggtgtcaagcttccttcactcttgcactctgcacacctacaggcttaacaccacatggaagctgccaaggtgtatggctggaaccctctgaagcagcagcctgagctgtgactatggccctttgagccaaggctggagctggaacagtctagatgcaggcagggagcagtgtcctgaggctgtgcagagcagcagggccctgtgcctggacaatgaaaccattctttcctcctcatcctctgggcctgtgatgggagggttgtggaagatctctgaaatgcctttgaggcctttttgcctctgaggcctatttcctattgtctcagttattggcagtcggctcctttttagttatgcaaatcctctagcaagaggttactccactgccggcttgaactcctctcctgaaaaagctttttctttctttgtcacatggccaggctgcaaattttccaaacttttatgctctgttttacctttaaatataacttctaactttaattcatttatttgctcctgcatttgagcatagggaattcaaagaagctgggccacatcttgaatgctttgctgcttcaaaatttatggccacgcttggtggctcacacctgtaatcccagcactttgggaggcctaggtgggcagatcacgagatcaggagatcgagaccatcctggtcaacatggtgaaacccatctctactaaaaatacaaaaaaattagcttggtgtggtggcgcagacctgtagtcccagctactggagaggctgaggcaggagaattacttgaacctgggaggcagaggttgcagtgagcccagatcatgccactgcactccagcctggtgacagaataagatttgatctcgaaaggaaggaaggaaggaggaagggaagaaatgtcttccccccagatgtcctgggtcatccctcttatgttcaaacttcaacagatccctagggcatgaaaataatacagccaaattatttgctaaggcataacgaaagtgacctttgctccagttcccaataagttcctcatttccatctgagactcatcaccctggccttggcttgtccatatcactgtcagcattttggtcacaatcatttaaccagctaatcgggaggctgaggcaagaggatcacttgaacccaggaggttgaggctgcagtgagctgtgatcacatcactgcagtccagcttgggcaacagagcaagatcctgtctcaataaataaataaataaatacataaataacttaagtttatttaaagctgcatctttgccaccatggagaaaggccaggccagctccttctctctttctgcacgtgttcctcccacctcagctgcctctgctcctcaaggaggaacagagggagtaggaaaggccatcccaggaggcccagcaccccatgacctggctctggggccttgtgggtttatggattcccagtgctgagtcatccctcacaggctcttgtgggcaccttggacattggtcagaagcatgtggtccccgggaacacaccttttcctgatcatctgggaagggcagcttgtgccagcgaggccacctgttcagcgccacggcccgccagacagctgcagccacagccttgcctttgatcagagcaaacaccagacatgtgtgtcatgcccccaacccatctccaggggacacatgtcctttcttgccaggcctgagatgaacaagagagggacaagtccccaagcctctctctccttcctgcctcacccactccgctgttagattctcaaggtggatggtgggctaactagggcaaccgaccatcctggtttacctagaactgagggggcattttcaggaataaaactgcaaaagtctggagcaaacaggagcaagttggtcactctggggctggtggagtcaggtttccttctgcaggccccctccccgcaagcatgggtggaacccaggacaggaacacagagcaggccccaggaccgggcttgtcacttacaagtcttttttttttttttttttttgagatggagtcttgctctgtcatcagggctggagtacagtggtgccatcttagctcactgcaacctctgccttctgggttcaagtgatccccctgcctcagcctcctgagtagctgggactacaggtggcaccaccacgcccagctaattttttgtatttctagtagagatgagatggccaggctggtcttgaactcctgacctcaagtgatctgcccgccttggcctcccaaagtgctgggattacaggtgtgagccactgtgcctggccccactcacaagtcttaaaccatgcctcagcacatcaatgccatttacaaaaaggtagagggattttccaggcaaaaatagatgaaagacataggatgattgatcatgtcctgcttaaacataggtctgatgctattaagaattgagggctgggagcggtggctcacgcctgtaatcccagcactttgggaggccgaggcgggcggatcacgaggtcaggagatcgagaccatcctggctaacacggtgaaaccccatctctactaaaaatacaaaaaatggccgcgcgcggtgactcacgcctgtaatcccagcactttgggaggccaaggcgggcggatcacgaggtcaggagatcgagaccatcctggctaacacagtgaagccccgtctctactaaaaaatacaaaaaaaattagccaggcatggtggcgggcgcctgtagtcccagcaacttgggaggctgaggcaggagaagaatggtgtgaacctgggaggtggagcttccagtgagccgagatcacaccactgcactccagcctgggcgacagagtgaaactccatctcaaaaaaaaaataaataaataaataagaattgttagtattttgcaggtgtgacaaatgattctgtttctgtggcagaatgttctcaggagatctcttttgaactctcatggaaagcatcatgctgttggcaacatcacatttatttttatttatttattattttttagagacagggtcttgctctgttgcccaggctggagtgcagtggcacaatcacagctcactgcagcctcaacctcctgggctcaagcaatcctcctgcctcagcctcccaaagtagctgggaccacaggcgtgagccactgcactcagcccaatgtaccttcaatatttacatttctggcaaaggtagcaaaaccttaacaaattttgaatctagataataaaattatgaggctgggtgcagtggccctgacagggatggctcacatctgtaatctcaacattttgggaggccaaggtaggcggatcacctgaggccaggagtttgagaccagcctggccaacatggtgtaaccctgtctctaacaaaaatacaaaaaaattagccagacgtggtggtgcacgtctgtcatcccagctactagggaggctgaggcaggagaattgcttgaacccgagaggcagaggttgtgatgagccgagatcgcgtcattgcactccagcctgggcaaaagcaagagcgaaactctctctccaaaaaataaaaaaaaaataaattaatgaattaattaaaataaaataaaataatggatagtcactgtaaagaaaaaataaatgtatatatcagccaacaagtgatggaatagagcaccccatctccctggctggacagatacatcccacaacacctggaaggcggctccatgtagaactttctggactgcttgaggtgctgtgctggagcacggtgacagaggagctggaccatggacctcccccggcccccaccaagggcgaggtccccctgtggtgggtctgagggaggcatccgtatggcctctgcggcttgggcagggaatttggggtccaagtacttggtgcaaagcctggaaagagggtttgggtgctgagggcatatcccctgggccacatgggggcagaagtggggccccctgaagcttggagtcctgggcaggggcatctattttgctgtctgaggccttcagtacttgaagcaaaatggaggcagaatgtcccaccttaatgcccctgattcctccaaaccaattccagagacagcaagggccagaacagggatggccctgcccagggtcatgcancgaggaagtggccaggctgggatctgaacccaggctaatcccctcccttgtcctcctccaggccctcacccctgcatagagccctccagctcactcatcctcggccagctccatctcctcagcttgtaaacccccccgggattttcctttcttaaaaaacaaaggcttggccaggcacggtggctcacgcctgtactttgggggtggctcccagcactttgggaggccaaggtgggcggatcatgaggtcaagagattgagaccattctggccagcatggtgaaaccctgtatttactaaaaaaaaaaaaattaactgggcatggtggctagctacttaggaggctgaggcaggagaatcgcttgaacctgggagaaagaggttgcagtgagccaagatcgcgccactccactttaacctggcaacagaacaagattccgtttcnaaaaacaaacaaacaaacaaataaacaaaaaaaggcggagcgcgatggctcgcgcctgcaatcccagcactttgggaggctgaggcgggcggatcacttgaggttaggagtttgagaccagcttggccaacatggtgaaaccccatttccactaaaagtacaaaaatcagccaggtgtggtggtgggtgcctgtaatcccagctactcaggaggctgaggcaggagaatcgcttgaacccatgacctggaggctacagtgagctgagattgcgccactgtactccagcttgggcaacaagatttgtttctctaaaaaaaaaaaaaaaaagactggcccttccccttcagctcttcctcagggtccctgagcactctacacccccgtctacactgagcactccaccctgctgtctacactgagcactccaccctgccatctacactgaggactccaccccactgtctacactggctgcctcccgccctcacctcctgctaaggccattccccgctgcatctgtcttctagattctgcagccttcagcacgctgggcccctcctttgtccccttgagccacctccagcctccccctgagctgctactcctctcccagcagcctccacccaagcccctccagtccccaagctgtcccttgcatccagcactgcccttccacgtgccccttccctccagcttcacagcagggtggggcctccaggccctgcccactgtgcccatccacaagttgtggtgggagctccgaggggaggcaggggtgtgcatggacttgggacgtccaagtctgggaccaggggcagctggttggtggagtgtggagggggatagggactttcaggtagagaggctgtaggggcaagatcgggacggcggatgtccctaaggagggctctgacctgggaaatattgtgcagcttcctctttgccattcctggagctcagacactggccggctctcaccccgcccttcctgcaggacacagctccatcccagtgagttcctagtgtagacatctccagcagcacggatgggaaaggaagtcatcaaaggtgcccaggaccggaggctttttctggaggtggcagaggagggtgtgggtctcagggctctggctgagggcaagcgtgggaggtcttaggtctgcaccagccccgtgaaggcccctcctgctccctggtggagtcctagagggaacagcagcccctaggctctagcaggagtgggtaggggcttttctggcttcctactgtgccagcaggatagctgggcctggcactgagcccaaagatcacatgccggggcattggcgcagtgaggaacagacccttgccaaagctggcaaagaagaccccatggggtgcagctggtgaagctgagagctcaatgtttgggggagcctggcaaaaggggtcctcccctccctctgcaggccaggatcgcaggttttccctacatgttggtaattctcaaacaatcccatggccactggagcaaagatcacagtgggcggcggcctcgggagcagtggacagggcacgcagtgcctttgatgccagagccctcgccccaaagtcaacaaactctgcagcggactttgcacccggactttgttttcaccatacaaggaaagggacagatcacaggccctctcgctgccctcgctgagccggaagctgcagcgtgagctctctcaagccccatttctaggttccccaggcgcacccctgagcccctactcgcctattaagttctcctaatagcccttcaaggtcttaatgtatgtccattagacagaggggaaaactgaggcgagggcaagtgacttgaccgaggttcctcggcgagcagggcgtggagctgagaacctcgttattactgctccccacacaaccctctggccgttcttggaagaaggctgagccccgggggggccagagtgacccaaacaccatgggccgcctgcggtaacacgtgcggccacgaaggggcagcagtttcccgcccggccgggctctctccggcgctcagtatccgtcccaggccaagaagaagaaactcggggaggagggcggagggggctgcgtgggagggcgtggaagatggacgtggccaggggagtggcagctgcacacagtggatgctgttaagatgaagggaaagaacgtgggctccgagatcactggacacggttccacctttcttcccgctcactgcatggccctgggcgggttgttgaacccttggaaacctgtttttccttttttcctttttttttgagacagggtcttgctctgtggcccagactggagtgccgtggcacgatcttggctcactgctgcctcccaggttcaagtgatcctcccagctcagcctcctgcgtagctgggaccccaggtatgtgtcaccacagccggctaatttttgtatttttttgtagagacgggatttcgccgtattgcccaggctggtctcaaactcctgagttcaccggatcttcctgcctcagcctcccaaagtgctgggattactggcatgagccaccgcacccagcagagacctcagttttctaacctgtgccagcaggaataatgatagctgcctagcttggctgtgctgggaattaagtaagatgaccgggtagcaaatatgaagtattactggacacagagggccccaggctgggttagcagcggtggtcagggctgctgcttcctggcctgagctcgaaggagggccctcattaccacctgggtgagtcctcgtccaagcctggcactgctgcgtgggaataacttctgccacccaagttggcagattgtgtgcaaagttaagtcctgactctgtggggtggacttcgaggcctcttcatcggacctgcttccggtgactgcattcgcacctcctcctgttcctggtttaacacagcccagctttcctcctgctgagccctccctgggcctgctgtcaccctcgtgccgctgtgcctcgcagtgccactccctgtaccctgaatactttgccctgcctctccacccagctgagagtcagggcccctgtgaggctctgcccagcccgtcctccgggtttctgcctctgctgagcacttccctgcatgattgcttctgagagtccccccagcctgtgagcttctcaggactgggacagcttctcaggaccgaggcttcctggtctgcttgcaattttacaggcgggcacattttcccttggccaacatcagagactggacatctgcagatctgtgctagccactgagcacccaggcaccccagcaggtagctctgtaaccaacccattctgtaaagctgaggctcagagaggtgaagcgcctggcctggggccacagcctgcgtcagctgcagagccaggagctgagatatgcacctgcggctctgctcacagggtcctgcacagactgctgctggagccacctatgtagagtcaagagagttcatgttaactccctctcacatccctcagccagggtgggggctgacgatagacactcagggatggcctaccctccccaacaacccccgtcaggtttgccggatctccttggaagaaaagttctgggcagaattccaccgttggcctggcctacactctccttagtggcttaggaccctcagcggtggataagttgtgggcagaagagatgcaatcaggattctcacccactcaccccttgccagccccaataagctcaataagctgggctcggtctgaggaagtgtccaggaaatgtgcaaatggcctgggacagccctgtgttcctttcagtaaggttgctgaaggtgaggctgaaagttggagaaacagaagccagtgcttatggttttaattaagataatggaatgtatgtatgtatgtatgtatgtatgtatgtatttatgtatttatctttagagatagagtctcactctgttgcccaggctggaatgcggtgacacaatcatagctccttgcagcctcgacttcctatgcccaaatgatcctcctacctcagcctcctgagtagctgggactacagacacacgccaactatgcctagctaatttttatttctattttttgtggagactgggttctcactttgttgcccaggctggtcttgaacccctagcttcaagcaatcctcctgcctcagcctcccaaagtggagggattacaggtgtgagccaccacacctggcctggaatttatttgtattctgcttataaaattaatacattcttattgcagaaaagtttgaaaataaaagaaaggacaaagaacaaaaagcgtatataatttcacagctcagatctcactgctattaacatttttatttactttcaggcttttttctttctaggtacatatgcagagattattttattttatttattttattttatattttattttatattttttatttcattattttattttattttattttattatttttagagacagggcctcactctgtcacccaggctggagtacaatggagtgatcatagctcactgcagcctcaaacacctgggctcaagcaatccccccactcagccttctgagtagttgggactaaagtgtgagtctggctaattttttttactttttgtattgacagaggtctcactatgttgcccaggctgatctcaaactcctgggttcaagcgatcctcccaccttggactcccaaagtgctgggattacaggcatgagccaccatgcctggcctaaaatgccactttttgtcatttactaaaatcccatggacactttgacatgtctgtattctatgctattgatctgactgttggcatctacatcattatggccatctatcatctatcataatccattttaacattaaaattgtgctgctgcttagatttttctggcctgtctcctatttgtattcttccagataaattttagaatcattttatcaaattccccttgcagaaaaagccctattggattttggttgaaaaatactgaatttttacattaacttaggaaagggctgggcacggtggctcacgcctgtaatccctacacttttcgaggccaaggcaggtggatcacttgaggttgggagtttgagaccagcctggccaacatggtgaaactcggtctttactaaaaatacaaaaattgccaggcgcattggctcacctgtaatcccagcactttgggaggccgaggtgggtggatcacgaggtcaggagatagagaccatcctggctaacacggtgcaaccccgtctctcctaaaaatacaaaaaattagccaggcgtggtggtgggcgcctgtggtctcagctacttaggaggctgaggcaggagaatggtgtgaacccaggaggcggagcttgcagtgagccaagatcgcgccactgcactccagcctgggcgacagagtgagactccatctcaaaaaaaaataataataataatacaaaaattagccgggggtcgtggcgtgcacctataatcccagttacttgggaggctgaggcaggagaatcgcttgaatccaggaggtggaggttgcaatgagcagagatcgtgccactgtactccagcctgggtgacagagtgacactctgtgaaaaaaaaaaaaaaattctgaaggattgagactcttagactcttaggtcttcctatccaagagcacaatatagcttttcatgtattcaagcctttttcaatgcatcaacagaattttacagtttttttcatgatatcctgctatttcttataaaatgtattcctagatattctgcatgttttccggttgtttgttaataaatatttttcatttgtcattatttcctaattggctgttatttgtatatatgacatctgttgaattttttgattactttgaaaatggccattcttttgtgtttttttttaactttctattttgagataattttgacttacagaagatttgcaaaaatagtacagagagttcctgtttcccccttatgttaacccagtttctccttatgttaacatcttacataactacagaacaattgtcaaatctaagaatcaacctgggcacaatgctattaactaaactgcagaagctgttcagatctcaccagttcttctactgctccccttttctcttccagtgttcaatccggaatcctacattatatttagttgtcatttctctttggtgtcttccaatctgtgacagttcctcagtctttctttgtctttcatgactttcatttttttatacttttgaaaaatactggccggttgttttgtagaacgccctcagtttgggtttgcctgaagttttttgtgattagatcgaggtcatgcattattggagagggtgccaccgcctcgatgtgcaagctcaatgcatcatatcagagggtttgtaatgtcagtttataccgccggagaccctaacctggagcatttcgtgaaggtgctgtctgccaggattctccactagaaagttactatttttccctttttaattactgaatgtctgaggggaaatactttgagactatgcaaatatcctgtttctgctttaacttcggctcactaagtttagcattcatctatggatctcgcttatagcaagtattactgtggagttctaatggtaattttctgtttctctcattccttcaacctttattaatatgcttcttcctcacttattcattttgtttcagttgtttataccaacatggatttgtggatattggttttattctttgggttgcaattgaatcctatcattattttgttagtcagttgttccatccgaccttggtcattaggagcccttgaaatttggctcccatgcctttttttttttttttgagaccgagtctcactctgtcacccaggtttgagtgcagtggcatgatcttggcttcctgcaacctccgcctcccaggttcaagcaattctcctgcctcagcctcctgagtagctggtattataggcgctccaccaccttgcccggctaattttttgtatttttagtagagatggggttttattatgttggccaggctggtctcaaactcctgacctcaggtgatctgcccgcctcggcctcccaaagtgctgggactacaggcgtgagccaccacacctggcctcctatgccattttaacatgcccgtcttttctttttctttcctactttctgtgactgtaagaagctccaggatacatttttgctgccctagacttagcctcaatcagttctcagaaaagctctggttctttttatgggatacttagaaaactagctctgtatggcctggcgcggtggctcacgcctgtaatcccagtactttgggaggccgaggtgggcagatcacagatcacgaagtcaggagatcaagaccatcctggctaacatggtgaaactctgtctctactaaacatacaaaaaattagtccaggcgcggtggcgggcgcctgtagtcccagctactcaggaggctgaggcaggagaacggcatgaacccgggaggcggagcttgcagtgagccgagatcggcagccactgcactccagcctgggccacagagcgagactccgtctcaaaaaaaaaaaaaggaaaaagaaaaaagaaaactagctctgtatgctagttttttttttaagacagggtctctcttgccccagctggagtgtagcagcacgatcacagctcactgtagcctcaaccttctgggctcaagcaatcctcctgcctcagtctcctaagtagctgggtctacaggcatgcaccaccgtacgtggcaatttttaaaaactgtttgtagagatggagtctccctatgttgcctggtctggaactcctggcctcaagtgatcctcctgcctcggcctcccaaagtgctgagattacaggcatgagccactgtacctggcctggccaaggtctgtctttttttaaaagaagttgttgtatagttgtttttttttttatttttttttctgagacggagtctcgctctgtcgcccaggctggagtgcagtggtgcgatctcggctcactgcaagctccgcctcccaggttcacgccattctcctgcctcagcctcccgagtagctgggcctacaggcgcccgctaccacgcccggctaattttttgcatttttagtagagacggggtttcaccgtgttagccaggatggtctcgatctcctgacctcgtgatccgcccgcctcggcctcccaaagtgctgggattacaggcgtgagccaccgcgcccggcctgttgtatagtttttatctcgagttttctagcgatttaatcatattggttacaaaaaaggatgattttactacctcctttccaatgtttctacatattttttcattttatctaactgcattttaaaataaacttttaattttagaatggtttcatatttacagaaaatgtgcaaagatagtacagagagttcctgtgtactccacacccggtttccttattattatcttaacgtgatacacaattaataaaccagtaacattattattcactgaagtccacactttctttttttttttttctgagacggagtctacttctgtcacccaggctggagtgcagtggcgcaatctcggctcactgcaacctccacctcctgggttcaggcaattctgtggctcagcatcccaagtagctgggaatacaggtgcccgccaccacgcccggctaattttttgtatttttagtagagatggggtttcaccatgttagccaggatggtcttgaactcctgacctcgtgatctgcctgcctcagcctcccaaagtgctgggattacaggcgtgagccaccgcgcccggcgtccatactttctttagatatccttcctttttacctaacgtccttcttctggttcaggatcccatccagaaagcaacattacccctcgccatcacgtcttcacaggctccccttgacgggaagagttcctcagactttccttgtttttgttgaccttgacagttttgaggaggactggtatcttagtctgttttgtgctgctatcacagactagctgagaccgatacatgatacatgaaaaaaaatgtattcttacagttgtggaggctgggaagttcaagacgaagttgctggttggtttggtctctggtttcaagatggcgccttgctgctgcatcctctggagaagaagaatgcggtgtcctctcactgcagaagatggaagcgctaaaaggaatgaactccctttgccaagccattttataatgggcattaatccacaaaggatgaaaccctgagaaacatcaagctttaaagcactggttctcaacctttttggtctcaggagccctttatactcttaaaacgttttgaggatcccaaaaaaaggcttctacaggttccatcttttaatatttaccatatcaaaaattaaactgaaaaaattttaaattatttattcatttaaaataacaaggataaacccattacatgctaacataaatcatgtattttatgaaaaatagctatatttatcaaaacaaaaattagtgagaagagtggcatgtataattttttttgtttattttttgtttttagatggaatcttattctgtcgcccaggctggagtgcagtggtgtgatctcggctcactgcaagctctgcctcccaggttcacaccattctcctgcctcagcctcctgagtagctgggactgcaggtgcctgccaccacgcccggctaattttttgtatttttagtagagatggagtttcaccgtgttagccaggatggtcttgatctcctgaccttgtgatccacccgcctcagcctcccaaagtgctgggattacaggcttgagccactgcgtctggcctaaatttttgtgaatgtctttaatgcctgccttctcatatttgtttctgcattcaagttattgcaaaatgttgtgttggttgaagtttgtaaagaaaatgtggcctcatacagttgtgtagttggaaaggcaagagtattttgattctctcttcaaacaactatggacaacctgctgttacaaaaccagaatgcaaaaagttgtagtaaatacaggttaggtgtagtgtggaatctgaaagcatgtgaatgaactttctgagttttgtaacattaaagtccagttgcgttaagctactgtgatagcatatagcattgtcctaatactggaattagtatcagaagtggggtgctactgttaataaataaaaagaaataaataaatcatgtgatactggctcagaagtcaggcagtaggctgtgtggaacctgacatcacgccatgtaatacattggcaaccatttgatccagctgtctgtcatgatgacttggaaagtcaaccacatacttacagagcctgtagacataggggaaaatagtataaaacagaatactaacagtggaccttggttcttgccagttgcatttagccaaatattaaacaaaagagatattcttgggcagcaactggaccatcttcaagtaaaagtgaaaggtaataaacagagtccagacatttgtgcccatgcgggttaagaaaaatccagttgcttctagacaccgtatatgaaaacaacgctgaaaacaagcctttgagtggtaaaggccgattaacactcagcgcggtaacaaagaccaggtgggctaacccgaaatgaaatgagaagcctgtggtgatgaggaggcagagaagtaaaatcaagtttgagcatttcgtttaggagagtttgggctctgattacttgcacatgcaaacgaactggaaacaaacagatcagatgtctaccacttcttcgagggaattgcattgccaaagaagtcatgaaagcagactctatactgattaggcattaaaacaaaaacaatctttaggcccctaaacttgcatgggcaggaagtgggctgtcaaagctgttcatcctctaaggtggacctagttcctagtccccagtatacacttcagatgtggccctggaggacactggacatggaggacctcccagaggatgaggctagggcttcatttctccaatgacctcagctgcctctatttccccttcttcctctggaagtcctatcatcgttattattattattatcatcatttttattttgagataaggtctcgctctgttgcccaggctggagtgcagtgacatgatcatggctcactgcagccctcccaggctcaagtgatcctcctgcctcagcctcctgagtagctgggagtacaggcacatgccaccatgcttggctattttttttttcagtagagatagggctctcactatgttgccagggctgatctcaacctcctgggttcaagagatcctcctacctcagctcctgagtagctgggattcgggtgcacaccaccatgccaactaatttttaatttttttttgtatggacaggatgtacagtgttagaaatggattgcttgcagaggcaggaggatcacttgagcccaggagtttgatcacactgtgaaccatgatcgcacccctgcactccaatctgggcaacagagtgagaccttgtctcaaaaaaaaaaaaaaagagagagagagagagactcaaagataggcaaaaaagtgggaaagctttatagtggacaaaaaggaacgctctaagtctgccctattggcatggtgctgaaggtgggctaactagagatagggggtactatgtggttgactatgggtgcatctttggctttccctgggtgatcctaagttggaagcagggacaaaaattagggaagctgttagttattcatcacgttctggcagtagtggactggttgtgatagaagttattgttttggccaggtgcggtggctcatgcctgtaatcctagccctttcagagttcaacgtgggtggatcaggaaggagggaggatttgggaggtcaggagttagcctggctaacctggcgaaatcccatctctactaaaaatacaaaaattagctgggcgtggtggtgcatgcctataatcccagctactcgggacgctgaggcaggagaatcagttgaacctggggaggcggaggttgcagtgagccaagatcgtgcccaatttcatctcaaaaaaaaaaaaaaagttatcgtttagcttcctcgattgttactggacgtagtaatctggcttcctgcaagtctaactttcagcagactggctacatgggctgtgtactgtagataaggcagtaagtaaagcaaaaattgatagagcatcaaggataaatagaaaatccgtaatcaagcagaagatttgaacacttcactttcagtaactgataaaacaagtagacaaaaaaaatcagtaaggatgtagaagatttgaacaacgtaattaacaaacttgacttgatttacacgtctagaaccctgcagaacacacactttttcaagcatactcagaacatttatataaagtgaccatatggtggaccataaagcagtttcaacaaatctcacaggagtaaaataacagaccgtgttttctgaccgtaagtacagttaacctagaaattgaaaacaaaaagctagaaaaaccccatgtatctggaaattttaatatacactttgaaataacaaatggatcagagattaattcaaataggaatttagaaataccttgaactgaaaaataatgagaatactataccccaaaactgtggggtgcagctgaacagtatatagacgaaaagtatactcatatgtgcataccttaaggagcggggaggattgaaagttaatgggaggcaaaagcaggtggatcacttgaggttaggagttcaagatcagcctggctaacagggtgaaaccccatctctactaaaaatacaaaaaattatccaggcgtagtgaggctgaggcaagagaatcgttggaacccaggaggcagaggttgcagtgagccgcgattgcgccactgcaccccagcctgggagacagagcgagactccatctcaagaaagaaaaaaaaaaaagaaaaggccaggcgcggtggctcatgcctgtaatcccagcattttgggaggccgaggtgggcggatcacgaggtcaggagatcgagactatcctggctagcacggtgaaaccccgcctctactaaaaatacaaaaaaattagccaggcgtggtggcgggtgcctgtagtcccagctactcaggaggctgaggcaggagaatgtcatgaacccaggaggcagagcttgcagtgagccgagatcgcgccactgtactccagcctgggcaacagagagagactctgtctcaaaaaaaaaaaaaagttaatgggataaacatccatctcaagaagttagaaaggaatgacaaataaaccaaaaaaaaaaaaatcaaaagaagaaaatcataaggtcaagactataaagagagtggctgggtgcagtggctcaggcctgtaatctcagcattttgggaagcagaggtgggcagatcacttgagcccaggagttcaagaccagcctgagtaacatagagagacctcatctttgctgaaaataaaaataaaaaattagccaggcatggtggtactgaggtgggaggatcacttgagcctaggaggttgaggctgcagtaagccatgattgtgccactgcacttcagcctgggtgacagagtgggaccctgtctctaaaaaactaaaataaggctgggcgcggtggctcaaatctgtaatcccaccactttgggaggccaaggctgaggtcagcagtttgagaacagcttggccaacaagatgaaacctcatctctactaaaaatacaaaaaattagttgggtgtggtggcatgtgcctgtaatcccagctacttaggaggnnnnctntngattatattttctccttcctacgtcgttattggactgaattcagaatgatgactctcattggagctcttcctgtctcctaactacagtggcttccgaccccactctggttttcacttcacccctctgctgctcatacgagtagatacttccttccttctttctcacttgttgctcttcctcaaccccccccgttggtgtcccctcctctttatctttttctcgcgacacctgcgttctcttgccctcttatcatccctttctcgaggcggtcctttcctttatccagcttaaataccttctcctctgtttatttgggggttgggtttttatctctcaccctccctctaatttctttcctctttccgcacccatcaagcctctcgtggtttctcttcctctactctcgggtcccccccctctccccttctttttttcttcacccccccaagcgctttgccttttttttctttgccctttattcccccc

SEQ ID NO: 7 - DNA, 29430 bp, Homo sapiens
  modified_base (4336)..(4336): a, c, g, t, unknown or other
  modified_base (4345)..(4345): a, c, g, t, unknown or other
  modified_base (4349)..(4349): a, c, g, t, unknown or other
  modified_base (4392)..(4392): a, c, g, t, unknown or other
  modified_base (4447)..(4447): a, c, g, t, unknown or other
  modified_base (4490)..(4490): a, c, g, t, unknown or other
aggggaagggccggctccgtagctcacacctataatcccagcactttccgaggagagaggatcatctcaggccaggagttcaagaccagcctgggcaacacagcaagaccgcatctctacaaaaacttcttttaaagcttaaaaaaaaaaaaaaaagcaaagaggacagttcaggagaaaagcctgtagaggcagcacactaaggaggagacgcagcccaggcaccaggaggggctggccatgggcactcactcctccagcaggcgagtgcccagcaccagctggcccacccagacacccaggacacggcctgaatggctccgtattcacgtgggtggtaataaacaagcaatacacatagccaataaggacaccttagtaatgttacatcataaacgctgcagatcagggaaatggtgcagggtgaagtgggttggggggctgcatgctacatgagaagtgggtcggggggctgcatgctacctgagacagagcaggccttgctgggaaagaaggagccggcaggcctgggcaaaggtcctggggtgggagcacactggagcagagtgtgggggtagcatggcgggtgctggtcctctgggcgccttcccaccacgtcatgtgcccatgtgcccaaggtctctcgtttcacagccccctgaagctcaggggtcacagctacacagcccccagataccttggcctgccccaggtcattccatccagtgatggacctgctgacctctagcctgacctctgggcagcgtaatttgagaaggaggagaagggagggcaacagacctggggcgatgagggatgcacagggtggcagacacctgaggctgcaccttggagcctcagttctgggtgtgggtgggggatggacaggctgagggctgaagcagctgggcccggccaccatcacaccccaggacccaccagatcaccatgaaaaaccgaatgtcaactggcagcccagagtgcagaacaaacctttcagaaacacggtggtgactgccgcatcatgaacataaaataattacgccctctccccagggatcacccctgcaggagtttgtcccaagaaacaccagaaagaaggaaaacgtctgagtcacaatatttgctgaggccttatttgtaatagcaaaaaaaaaaaaaaaaaaagaacaatctccagcggcaggggtaactagactattgtctccgtggaaaggtagcaccaattaactagtaacaaaatgactgcggtaacaacaaaacgttcgacatgtcaacaccaaaaaccacacacccagcataaccgtgaaccatgatttctactagaatgaatggcagttatgagaaagcaccagcggagacaaagattgaaaaagtaaaggtggcctcattagggagacaagtctctgggtaatatattgtaatactggtaaatatatagtttttaatatattttttaattccaaattccatatatgttcctatgaagctatttctgcaaatatttttttcaggaccgtacatcacaaaggcaaaagggccaggtcagctctccagctgagagtgaccacttcagagcagacggcagactccagggttagcaagcctggctgagacctggcccatgacaatcactcaacccctctgacctcaacatcctgtctgtgaaatggggataattactgcacctccacatcacagagtgcgaggcttaaacaggatgcttcatagaaaagcgctcaagaggtaacagccgggagggggtagtggttttcattaattaaatgttgccttcatccagccctgggccagctccaacacaaagcacacaccatccactcagactcagttgcctggattcaaagcccggcctggcctccagctgtgagattccgggcaggatttcccatctcccagagcctcagtttcctcattcatgaaacaggaagtgatcattccttttatttttatttttatttttattttgagacggagtttcactctagttgcccaggctggagtatgatggcgcaatctcagctcactgcaacctcggcctcccagtttcaagcgattctcccacctcagtctcctgagtagctgggattacaggcacacgccaccacgcccagctaattttgtatttttagtagagacggggttttgccatgttggtcaggctggtctcgaactcctgacctcaggtgatccgcccgccttggcatcccaaagtgctgggattacaggtgtgagccaccaagcccagttgacaactgcttttaaagacacctctggctgctgtggaaaacagcctggtagtgcctcaaaaagttacacatagaatgatcctatgaccagtaattccactcctacatatatacccaaaagaactgaacccctctactcatgtatgtacacatacaggtacacgcatgttaacagcagtgttcacaaagccaaaacatggaaacagctcaaatgtccataaccgatgaacggataaatgaaacgtagtctattcaccacctgacggaggtgagaggggccataaaaaggaatgatgcataaaaacgaatattatggccaggtatggtggctcacgcctgtaatcccaggactttgggaggctgaggcgggcggatcacgaggtaaggagttcgagaccagcctggccaacacggtgaaaccccatctctactaaaaatacacaaattagctgggcatggtggagggcgcctgtaataccagctactccggaggctgaggcaagagaatcccttgaacctgggaaacagaggttgcagtgagctgagattgcaccactgcactccagcctgggcgacagaccaaaactccgtttcggaaaaaaaagaaaaaattagccaggtgtggtggcgggtgggtccctgtaatcccagctctacttgggatactgaggcaggagaaccacttgaacccgggaggtggaggtagcggtgagctgagattgtgccactgcgctccagcctgtgtgacagaaggagactctgtctctaaaaaacaaaaacaaaaaaggcccgacgcggtgtcttacacctgtaatgccaacactttgggaagccaaggcaggcagatcatctgaggtcaggagtttgagagcagcctgggcaacacggtgaaaccccatctctactaaaaatacagaaattagccaggtgtggtggcacatgcctgtaatcccagctactcgggaggctgaggcaggagaatcgcttgaacccaggaagcggaggttgcagtgagccgacattgcaccattatactccagcctgggtgacagagtgagattctgtctcaaaaaaaaaaaaaaaaaaaaaaaaactaaacaaaagcaaaaaaaccaatgagtaatgttgtcaagtgaacttcatcccaatgggaatgcagataatttgtttaaaaggcaccatgcacactgggcaggctggcttcccctgggaacgtcttcttttgcctggattcccagttggtttaatcgggcgtagaacactttcttcaatccgggattcaggcacccctgctcagcacaaactcagtacaccccgcactctgctgtgggttcttggcactattaggagaatgtgagggggtgattcagatctatctctagtgggtgcatgtctgccactcccaggaacgcccacttctggcaagtcagtgtcagagaaaggccagctcgtggcccctcctgccttgagtcccaggacccgtgatcagtcctacccggagcagaatcaggagtttgaaaacccaagtgccaacaatctcattttaacccatgtaagcatatccaatatttatatatagaattcataacagatgtctgggcttccattccaatagcctatattttacactgtttatttacatggttacaccaaacaagactcaattcaaggtaacccaatcctttgctactataccaaaataagcaacattttcagtccatgccttatatatattcaccaagcattacactaggcctccaactgctcatcggagcaagctgcagcctggacacaagctagagattaatcagtcaggaatgatcctgcgtccagtgccagcatgatggaagagacagagaaacagaagacatcagggctccagagtcaaggagcctgcaggttagttgggcaggatatacacacatacacacacacacgcacacacaaaaccacccaagaagaaaaggtgggatgaatgcatggacaggtaatgcctggagcctggggatggataagctgactgcaggtggcccaggcaggcttcctggaggaagaagacctggctgtangtggggtangcangctttctaaatggggaaaatctggctgtgggtggagttggcangtttccgaaaagaagaaaagctgactatgggtacacctggctgttggtggaacangcaggcttcttggaagaagaaaatctggctgtgggtggatcangcaagcttcttggaagaagtaaacctgactatgggtggaccaggcaggcttcctagaggaagaagaccggctgtgggtgaaccaggcaggcttcctagacagaggaagatctggctgcggttagagtgggcaggcttctaagaagaggaagggctgactgtgggtagacctggctgtgggtagactgggcaggcttcctggaggaggaagagctggagcattgaaaaacaaacatgacttggtgaatgttgagcatgcccaggcctgatccccagaggcaattacgcactcaagttacttaattctactcacaatgcctcacaaacaacttctctgacacctaacacagctctgggcaccttctagcttcagctcctcaaagcagttattcacgctactaccctgcacacctcctcacaccccaaccccagggacaggagttctgccagatgccaaagctcctgatgccaaagcctgggtctgcttccgggctcctcttggtctaactgtccaccccgcatcggcatgatgtgcaaaaacaaggctttgcaatctgccctgatgcctggcggagcgagtccctcccgattcgtctccttcagaaacacctgggctgccctggtcctgttatacccccaacacattctacagtcagctccgcaagttccacaaagatcaacgctggcgtttttatggcattttatttacagtttttacaatataaaaaaggaaggatgccacagctcagccagcaggacagacagagatctatgatgcttctgctgcaccattgtttgtggtcaagaaagtctgttttcaatgatttattaaattgtggtgggagatggatggtggcagtggttaccagcaacatgaatgttcttaatgccactgaacttcacacttacaaatggttacgacgataagtgttatatgtattttaccacaattaaaaacaggtaaatgcaggccgggcacggtggctcacgactgtaatctcagcactttgggaggccaaggcaggcagatcacctgaggtcaggggttcgagaccagtctcgccaacacggtgaaactctgtctctattaaaaatacaaaaattagccagatgtggtggtgcatgcctgtaatcccagcttctcaggaggctgaggcaggaaaatagcttgaaaccgggaggcagaggttgccatgagctgagattgtaccattgcactccagcctgggtgacaaaagcaaaactctgtctcaaaaaaataaaataaaataaaaataggtaaatgcaaacatatggtatagtaatattatgggctattatgagctacaaaaaagaatgacttgggactacagttacagccctcattcaggaatttgttttaaatgtgggttggtcgctaaggcatgtacacaacattttgacgttcaaatattcctagatttggacagtgagcacccctctaagctggctcttctgtcccagaggtccccaccagtcctccagaacttctttgctttcttacacaataagatgccccatgctcggcttgtacctttccttgccccagccctagaaccagcttcttcgtggacaagctctgactcctttgggtggagaatggtattcagaaacccagacctgggctctggtgtgctcactgctacttggggtcattgcttctaggcctctctgctgatggaggtaggatatacacgtacagtcttccctcttcccagattccgtacttgagctcgcctacttgctaacatttatttatatcccccaaattaaacctcacagcacttctgcaatcactcactgacttgcagagtgtgaaaaaactgagtcaccatcacacgttccaaactgaggtcaactgaggccacaacgccccatcttcttgctccggctgtcgagatgtaagcaagtgtccttctctcggtctagctagtgccatgctttccacatcactgtgctttttgtgggcaattttgctgtataaaatgtcccctgcacatatgctgctgtgtagtgctcctaggtgcatgaggctgccccacgccttacagagagaatatgcatgagaggctttattcaggtatgagttatagcgtagttggccatgaattcaatgttaatgaatcaacaatatacagtaaataaggtgctttttagagacagggtctcactctgtcacccaggctttagagtccagtggtgtgaccttggctcactgccgcctcaacctcctgggctcaagtgatcctcccacctcagcctcccaaactgttgggattacaggcgtgagctactgcactcagcctaaataaggtgtcttagaaacacacataagacaaggttatgggctgagtgcggtggctcatgcctgtaatcccaacactttgggaggccaaggtgggaggttcacttgaggccagaagtttgagactagcctgggcaacatggcaagacctcatctgtatatttttttaaatcagacaggtgtggtggtgcatgcctatagtcccagctactggagaggctgaggcaggaaaatggcctgagcccaggaggtcaaggctgcagtgacccatgattgtaccactgcattccagcctggggtgacacagcaagacgctgtcttaaaaaaaaaaaaaaaaaaagccaggtcaggtatcgaacagttggcaaaaacgttgtgacctgaggctcacaggaacctagcccgatgtttcccctaggagcaatggttcagtattcaataattcagggttcccagtgactttatggagcataactttcaagaataacaagaaccaactgtacgtgtgtatgtatactcacacttttattttattttattttattttttgagacagagtctcactctgtcacccaggctggagtaaaatggcgtgatctcgactcactgcaacctccgcctcccaggttcaagtgattctcagcctcccaagtagctgggattacaggtgtgcccccacaaccggctaatttctgtatttttagtagagacggagtttcgccacattggccacgctggtctcaaactcctaacctcaagtgatccacccacctcagcctcccaaagtgctggaattacaggcatgagctgccgtgcctagcctacatacacttttatacacacatgcatctatgactatttctctatttctgtgcatgtgtgcgtggcagtacctacagtttcagctatgtgtctgggtactgtctcgtccaagtttgtaagcaccttctccaaagtgcaaagcctggcttgtgttactatccatatgtttacttatttgctcaatcaatttacttattagctccataaccagcttcccatctgctccagtagcctctgctgtcagtcacctctgcaccctaccccaccttgcttccggatgctggatgccaatcacccccgacacctctacatagcaccaccctcgacatgctgcttctttatttcttatttatttgtttgagatggagtcttactctgttgcccaggctggagtgcagtggcacgatccaggctcactgcaacgtccgcctcctgggttcaagtgattctcctgcctcagcttctcaaatagctgggattacaggtgcccaccaccacgcccagctaatttttgtatttttagtagagatggggtttcaccatgttggccaggctggtctcgaactcctgacctcaagtgatccaccttggcctctcaaagtgctgggattacaggtgtgagccaccgcgcctggtctgcttctttaaatgccaggcaccaacatttgtgcaatggggtgggaggaaagaacagggaggagagcacactgccggcccctgcactgaatccactgatcaatctgggggcaactgccatctccatctcctgtcttcctatccgtgaacatctactgcagtcctctccaatgtccttctgtaaagttgtattatgttttgcatacaggccttgcatattagttctcagatataatccatatactttatataaaattcaaaccacatttaaaaaaataaaactagcatgactataacggagtctgcaacattctcacagactttatgataaaacatgaaacttcaaagatacttagggtggggcagggacaatgtttaaggctgcctggaagcctccccatccctgagccagaaagtcctatctccccttcaaggggaaatgcttgaaaaagcactgatcaggctaaaatgacagggatcagggagtaatcaaagtacaagtgagctggtctcctccattctgagcacagcaaagttcagtctctccaagtccaagaatcatacacctgtttgccaagaatgaagttcaggtgtctacaagtggctgaaaatattcattgctgggccattaacaacattcttggcaaaaccataccttagcttctcgtggaaatttcttaaggtagaagaaacaggaaacacccaggctcgcttttatgtagacagttccatgaagccagggaccttccccacatccacgtttcaattacctgcacgcagctcacagtgtattcaacatctacgcgtctctcctactggggtggcggtggccactcaaaccctcatgcagctacgatgaccgcaattttggcaacataatttcatgtttttccttgggcttttacccaagtcagtgacacaattctgcagttgtctaaagattcaaaatgagggacttgacatttacaacaataataaaatcttgggtttcctttaaccaagcacatgttctgccttttagagaaagctctgcaaactcaagctggagtgggatacttgctgacatcttcaagcaccccaggaatagctctactcccccatttccaccttggctgaaccatctatatcccaccaattcccccaacatccctccatccgtccatccatccacccaaggacctgctaagccaggaggtctctcccatctaccccacagcctggcctcagcccacaagggctctctctacatgaatcccaccgcaccagagtagaccaagtctcccgtagactccaccctgaccacctccatgcctccagccattcccacccctaaaaaccctccctggtctctacacccagctgatgaatacttggctgaatgtgacctggcctcctggacccaggtgaagcccacgtcctccgtaagcccgccagctcaccctgcctctgcaccttcactggagagagcccgcacttcacctcctcagggcaggcatggctgatgccacccagtggaatctggtgcaaagcagggcccggtgcagagcagggctgcctgcagagcaaggccctggtgctggggccgagcacctccaatgctggccgtggaaccatccctcccattccaggtgctgtctccatcaagaatgagcgagctgctgacatttgcatgacaataatgaataaataccatattttgcttcaaatccagaatagatgtggccagggttggcatatgactgttgggaaaggacagtttgcctcttcccaaaccaacttggattataaaaagcttttcttaacgaccacaagagcggaggagctcaggggcagacaaaaggaaggctggctgcagaaggcgggagagtggggccttcaggggcgggtggggagagagaaagcctggagctgcacccccaaggtctgtgtacatcaggtgctacagaataacaccacctcttccagcttggcccccacctgccctctcccagcccagtcacccagacagcaccccactccccacacacacctcacatctgcccgcctcacactcaccagcttcggctctcaatgcaacctggaacctgcccttggcctctcagctcagccacccccattcctgttggcccctggccccccatcgaattctctctaatcctaatgcacacacttgcacactcaaacacacacacacacacacacacacacagcccagaggaaaaccataattgactgaggtccaggcaagtttcccgagcagggaccacatttcaaaggtcagggaagcaggcgaacaggaaacatacagggggcacgtttgggggtggagcaggaaataagaaatcacttgcaaaagataaaaagaaaatgaggtagctggtttcagacacctcggagcacacagaacaggacaggcgcctccgggtcttccctcaacagggagatgggccaggcaggtccctgctgctccaccgcagagctgggggctatggccctgacaccaaggccctggggcaggcggggaggcagctgttctcctgcctgtgctcccgggcagggcctggccccacaagggaactggccgaaggctctgcttggctactccggaaagtcctgggagacaagcaaaggacttgctaggtcactccaaacggcccagatgtgacaactgtgaagaagccacaccaaagcaaggtgacagaacaatgttggtgacgtcaggttatcagcttacgctcaactccacttacccggactcacccgtaacctgccgtctcttcccaaccagtaaaggatgcctaggtagaggggcacaaggcctggagcataattaccattttaaaggctctgagaagtcctgcggtgaggaagcctagttcactttctctcccctaggatttcccaactgcgcctgatcacagaacattttttcatttccactcaggaaacatattttgaaaaacactggcctagaggcagaagtgaaatggaaaacacaaaagtaaaactgaacaggaggcactgggcagagaacggtcagaggcgccctgaatcctggaccggtggagatccccagcttggcatgctcccctccctgggcccagaccgcctccccccatttcctggataagaaggctaatgcgcatcagggtgaagggcttgcctgggctacacccccaggctcgccccacaccaatcgcgctcctgcgagagccagtgactttcttgatttggctactgtggaattgtttgcaactaaccaccccagatacagatacaaatgacaggatgatcagatgtaaaggacccacaggtctctgtgatacggcttcatgcagccagcatggctagtgccgtgcagaatgagaatgaccccaggcaagtccttgcctcccagacccagaaccccatggagcccaccagggctggttcacaagcactgtctgggtcgggcagagattccagcaagaggagggaacatccatgcaccggagccagttaccagaagcaaatcgcctcttccaaaacccaggctattaatggagtccactgttgagtggagctggggtctagctatggaatactgcacagcagagatcttcctgagagaaagcagttttccctgaaagccatgtgtcctccactaactgtgttttaattgggcgaacgtctgtatctcattgcagtggccgcgcatgtgctgacaaggggctgggggcggggtggggagcagaagctcaggggcctgggagggaaggaaacaggccaccagggctccccagaaggcatgtatctctctcacaaacacacgcatgcacacacacgtgcacacatactctgcaagccctgagttagcaactgtggaatgtgaccagctcagtgatcccaggacaagctgctagggaatatgacatttgattgatgtctgcaaatgtgcgttttcactaattagaaggtttagggcagagcagagaaaaatatgtatttcagagtcccagtttgacctgccagaaaccagcccattactaacattcttattttcaacaaaatatagcattctgattacataccatcttggttccacgcctcctgccttgccaagcccccggaagcggcccaaggccatggcaaatagtgagagaaacagttccagggtggagactgactcaggggtgtcagtcagtggggcgctgatggccggtgggaggccagcagtcatcaccctctccttgggacagttgagtagctctcccccagggtcatgtggccactcaggttcatatgggaggcgagaggagtggcagagtccaggagagtggctccgaagtcactgttccctccaggcctcagtgtcttcatccattaaatgggtaggctgaggtctgggatgacaaggagggcttgcacttactgaaacccatgggaggctgttcgccgatttcttttattgatggaagaaaacactcgtataattcaagtaccaattaaaaggcaggcactggaaccaccgtctgccaattcctagttttgcctataccaaatttgagcaagttaattgacctctcccagcctcagtttcttcgtctgtaaaatgagggtagggatggcccccagcccacagggcagctggaaggattaaagaaatcaaacatctcttagagcccacctggcacactgtgatacacaacaaatgttagctatttttgtctatgaagtctagattttatatcttgggtgttctaaagcaggatacatttatttaaaaacaaggattttcattaaacacgtaccccacagacagcaaccccatggagactgctcttaattcaggccagtatcgaaacgactctaactacaagctttatacaggtctcttggctgtccttcaaatccaactaaggtggtacttctgaagcactgtgcacatgtgtgtgtgcatgcacacgtgtgggaagggcgggctcacggatccctcaggtaccccacccacgcagtctcaagtcacaaagcgacagagcagccgaggaaggtctgtgccccactggaccctcgtgaagccaccaactctacctctgcgccgtgtcctgcagactgggctaccctttgggtggggaccagcatttgatgcaagaaaggcagacagaaaaggaaaagggcaagttcgactccagataacacagacagtaccaagccccagggtccataaatgccacgcagatggaagcatttactgcgaggccacacagcaaacgcacggatccagggacggaggtgcagactgcggtgcccctgagccatgaccctgcaaattaccaccatgggaaaggaggctgccaaaccccccgacagtcggctgggctggcacagactcgtggtttccatcgaggtgggaggaggtgggacgtcccagcccctcccccatgcccactgcagagggaagcggccgtttcccctgtgtggttacaaaggtctcattgttcttcctcacagggaggaaactggaggaccgagctcagaacgcattttagaactggcagaaaagaacatctggggaaggaaacacatttcagaaacaaacatacctttgtaccagcttttattttctttaagtgttgaaaaaataataataataaagacatgccaaatttatcatcgctctacaaaatccctttattgagcaaaacgtggcagctctactttcaaatgattactgttcctggaaaattgcagcaacgtggatgccaaggcccgaaggccgccatcagcagccaaacaaaagatgccacctcgggctccgcgacactgtaccatgccagggaactggacagatttggggaatgccacggtttgcctttaaccccttgcctcctggtctcctgatgcatctcagaggctaacattctttgaggaactggcatttcttagttgtaaatatgcatgtgggtttgggagctgcctgcaaagtccagtgttgacgatcagctttgatttccttggaatcaagtttacgtgtcgagtctggaagttaagaagaatttggagaagctgagcactatggtgttgcaggccctgggtgaactcttccaccaagcattcattgtggactgacagcgtgcgaggggctctgcaggcaggtgcacaggacgaaacacattccgtccgggggaaacctgcaggaaagctccctcttcttcctaaggtgccgggcctagcttcatgggtccctaccctccacgcctgtcacactttctgagtctcatgtgggagctgcttctggttcctgacttcactcagtcctcataggaggtggaactactgtcaccccattttacagatggggagactgggcacaaggggaccaagaaaccaatgcaaagtcacacttgtgggatcagtgacaggggagatcaattcccaggttctttctgcaagagttaaattgttttcatgctgcctaagggggggcaactgaaagaccactgcatatctttgccaaaagggtcaagcacaggagccgcagccagtgggtcagatccgcagaggcgctggggtgaccctccccatacctggagggatgcttgtcccctcctggccttcactgggtcccctcatgaccgtggcctcccaggacctcagcacaatcccggtcctgtgctccaggacaagccctccgtccccaagactgtgaggaaatggaacgaagaggggctcgctgcagcccagcacccacactgccccttctcaggggcaagaaccgtcctggaggacttggctttggagggggagcctgggaggccagtaagtcaacaagcctctactgctcatgggtgggatcccaccgcaggcccccacctgctggggcgggcagggacgggcggcacagcttggccagggcagataacccccaccttggccagggcgaaggcaggacacgtgggctccagcctggccccaccatccctgcacaacactgggcaaagtccacgttttcctcaactgggtgttgacatctgcaggacaggggcatggaggtacagagcgctgaagccacacagcaacctaggagcgagactccatgcctccccggggacccctccccaccatgaggaccatgaaggcttcccatgtgccgcaaggactctggtgtggagacacacgtctcctacacagccaggcctaacgctcttgtaactgggtggtcccacctgggctcacagctggagggccaggagctcaaggcttcgcagggtctgctctcatcccagaggcgatggggagccacagcaggctgcaggagagagggtgggccccctccacttcagaggccccatctggcccacagactggagagcacatctctcagcaaccacggagcgccaactgcgcacagggcctggtcgtcagagcggggcaaaggcactgaccgtcacggccagggcgagggaagacgggtgggcagggaccttgggcagagggggaagaacctggtgcccaggctggccctgccttcagcagtgaagctgagtggggaggcgctgatgcagggggccagaaagggctgctggtcagccgggaggagccccccacagaggaagcagccagcccagacgcagatggcagggtcccctcaacaatgtcctctgaaaaggagaggcggggactgctctggtgacacctacaaatagatagtcagccctcagccccctgccatacttctgacaaagcagaggcccccaggggaggcgcacccgaaggtacctgcacctgtcccccagactcctagagcccacctgaccccatcccaccagggctccagctacaaaataaatgccgaggccagctaggcaaggacgcacactcggtaccgactgaataggctccacgttgtcatgagcgcaacccacaggccaccaggccacactatgcagagctgagatggtttcggccaagcagcctctcagctgagctgaacaagtccagagtccccggggggtcgtcactatggagtaacaattgcgatgcgatggtaaccctaacagctaaccgtcactgagccaggccctgagctaggtacttttcaacgctgcctctctgcagcctcaggacgagcctgtgggagcataaagatcattccctatcacggatggggaaactgagctctgaagcagttaacgtgcttgtcccagaccgcagagctaggagcaggacacaacagcaggtcaggcaggaacgggtgaggggggcctgcatgggcttctctggaggctgcgcatacacgcaacccccaggaccccgaccctgcacctgcagctcgctactgccccctcagtgactccagcaaacctcggggtaggggaaggaggctgggaatacctcgggtgtccgaaacagcagcttctgcttggaggccactgctgcataatggttgctgcccagcacaccccaagccacctgtgccacctgtggtgaccttccagcatgccttggtgaccaagctggccttaggtgctgtgggcagccaagaatagaacagggcccacccctcctcttcacactaacacaaagcaagaggcgggcacttcgactgagtgcatccctctagctcaagggcctcacggatcacaggggtcagggcaagatcccaattctgcattcccgtctgcctttcatcctgctctgccaacaacagccagtgaggctggggacatccctgaacctgtttctcacctgaaacacatcataccattggaccccagccctccgggagaggccctaatccctgactgtggtgagatcagatcactggttaagtacccagaagggccttggtcaggggctccaggggtggggggtgatgggcgtggtggtatcccgctctgggctatagtccaccctgatggaggaggtctgtggtcagaaccgggctgtgcagggcacaggagcccagagggacccccagagctcacctggtggtctctgagcagggctccctcaaccctcagagaaaagcacagcaaggaggccgcccagagcccagcgcctagcacccagtggcgtgccagacctgcctggatcctggagatctctcatcaccctccaagtcagtcatgcccaacccagggacccacagcccacggggccgtgaaggtgtgctgagtccaagaaggccttcgacactgggaagccaagtggcacctcctggtgtggagcaggcggaatcccaccagcctctgctctgccagtgggcacagctggacgatgagcagaaggggctgttgcttaataaacgtcatttccttaagaggataaaacctttcaaaacagatggaaatttttttttaattaaaactggtggccaaagagatggaaagcaccccttgtgcctccctcccatcgtgacccatcctctgcacacctcaagctgttcgctgcccaggtgtctcctgaggcactgggggcgggtgagaatccgtgagccctcggccagccgtggctctctggagctctgccccaggccatcagggcacacgccgggcaccctgggggccacacagggcagagcccagctgggtcagcacacagggccacactgggcacacaagtctctgagcctcccctgtggacgcagctctcactatcccaccccactaggtcccggggatctgtcccacagggtgatatgctgtcacagaccactaccagagccatggcctgctgttccgcccgcagccaggtagtcacttgctccacagggacaggcaacgccgcacttgggggctgctctgcggcaggactagagctccagcagctcagccctcctgagaaggagaactccatgctctaagaggcagacgcagcggacggcaccaaagccaccacaagcccacggggccctgcatggcaggtcaggagtccctgaccactcgctctttgtaaccagagctgcagtggagtctacgaggcaaggactgtgggcggcagtggccacagcaaatgaatgagtgtcccaagggagcaggcggctgcggggaggcacagccgggacccaggagtcctccggcactgcagcaaactccctgggccccctgagcagcgaccaggtggcaagtgcatgaactcccgggggcataacctgggagggtgacactctcttcgtgttcaaattcttgagaacgcattaaaaatatcactcagtcacctactctatagttttaactcaaaagtaccaaagtagccaggcgcggtggctcacgcctataatcccagtactttgggaagctgaggcaagaggatcacttaagcccaggagttccaaatgaacctgggcaacatggagggaccccatttctacaaaaaaagtgttttaaaaaattacctgggcctggtggtgtgtgcctgtagtcccagctactcaggaggctgaggcgggagaaccacatgaacccaggggaggtagaggctgcagtaggctgtgatggcaccactgcactccagcctgggtaacagagtcagactctatctcaaaataaatttaaaaagcaccaagccaggcttggtggctcacacctgtaatcccagcactcagggaggctgaggcaagtggatcacctgagtcagaagttcgagaccagcccagccaacatggtgaaactccatctccactaaaaatacaaaaattacccaggcgtggtggcgggtgcctgtaatcccagctactcaggaagctgaggcaggagaactgcttgaacccaggaggcagaggttgcagtgagccaagactgtgctactgcactcaagcctgggagacagaacgagactccatctcaaaaaataaataaatcaatcaaaaccaccaagactttttaatataaacatttattattccataattccttttttgcatgattaaaaatgtttatataaagtttcctgaaaatggtaagaatgccaagtgaaggctgcaaatgcccaagcccccaccgtggcatctcacggagtctgggccctaggaggctggtgggtaccacgtggacccgagacttcacagtcaagtccctttggggtacactgggtttcccacaccccagaaatatgggctcttactgcaggaccatgggggtcctcacacttggcccagaagctgtcacatagccagacaggtgttctacaacctaggctagagggagctcatgctccagcagaattcgagccagaggaggtaaaagatgggtaagatctgctccctggacagatgaggccttggcctcagaacagttactgatcatctaccagacatcacactagaggcagaggggcgcagacgaagacagcccctgtcctcaaggccctcccaggttgggtggaccatggaaggttccagacagatctggcaagagaagtgcccacaccaggggcagaagatgggcaggtctgctcagggcggcacggcctgccaggccaaaaagttccaacttcagatgctggagaatgggcacgactgtctgagaaagggaaggatgtgatgaaaactacttggagaaaaattaatctggccagagcataagataaatgggcaaaggggaggttccagaaagcaaggagaccaagtaaaagctgatgtcattggctctgaatctaggctttcactgaatatgcaccgcagggcctgtaggtaaagcctcagagcccagggagtctgagtggaggagagggcaggggacagagctggggcctgtgtctacagtgctcaggaggaataggcatggacgtcagctcggaggctccagctgaagtgaggaggcggccagggcagcacggccacgcccggatccagactccttttgggaagcaagttcgctctgggggaaagtttggagaaatggcctttacccgcagaagcaagccccagaacatatcttgctccaaaactatctcgtacagtgaggacgttaagcttcaggtcccctagaggagacagtctgctccttcctggggcagaacccaaggtggccagagcctggaaggcacccagcacccaggctggtgtgttccagcccaggccacacgctcagatagctattaatgccccgttgagcaatttcctgagagctttgccaggcaggtaccgcctccccatctgaactaatacaggggtacatcccaaggaagaaatgaaaggtgcccacattttgctctgggattaactagggaggggagtgataattaactcagtaattatatttgccatcgggctaatgctaaaattagtgtgcattagaatttctttcctgagcagacaccggagtgagttgggcagcaggagtggctcgggcaagtcggcacaaagggcacctccagagccttccacaaatgtcagcaaaacccacaaatgtcaaggccggctccactgcacccagcagatgaattcacttccacagcctgagaccgccagctcatcggaggccatttaaaatccagccctctgacacctgctggatatcaccatttaccgtccccagatcaagagatcaaagggtggaacctgataggacggctctgaagttcaccacaaaagcataaacgtgcaagcagagccaatacgtcttttgaaaaggacaatgaggtgggaatttacataactgatcttaaaatatgttctgatgcttcagagatggagacagcagcattccggtacacaaagacactcacaggcagtggagcacagtgaagggtctggaatcaggacccaggtgtctgtggacactacacataaaagagcagcatttacaatgaatggataggatggaccatcccaccaaggtgttggacaactccctattcactggccagacccctacctcataccatatacaaaaaaaaaaaaaaaaaaaaaacccagacagaataatgtctgaatgtaaaacataaaacagtaacagtcctggaagaaaataatggaggatatatttataatctggagatggagtaacaagggataggaaaaaagccatagggaaaaagtagagttatgattatatgaagcttcttaatatctttatgataatgtaccaccagaaacaaggatgaaggactagctacagaccagcagtgaaacctgaaacaaacagaacaaagaattaaagtccataccaaataaagacctcccacaaatctataagaaaaagataaacaggctggcaccgtggcttatgtctgtaatcccagcactttgggaggcggagatgggtaggtcacttgaggtcaggagttcgagaccagcctggccaacatggtgaaaccctgtctctaccaaaaatacaaaaattagccaggcgtggtggcgcatgcctgtagtcccagctacttgggaggctgagccaggagaacagctggaacccgggaggcagaggttgcagtgaaccaagatggcaatcgcgccactgcactccagcctggaggacacagcgagactctgtctcaaaaaaaaaaaaaaaagaagaagaagaaaaaagaaaagaaaaagacaacagaaaaatgggccaaggataagtgtaggcaatttgcagaaaagtaaataccaataaaccagaaatgagggttgtgcaaatcaaaaggtgttataatttttaaccaaactggaccaaagaaaacaccaaaaaccaaaatcttgtaattgccagcatcagagaggatataggaaagtgtgtgttctcgtagatgcttgcaggtatgaactgctacagccttttaggagttatgtatgtatgtatgcttgtatgtatgtatttgagacagggtctcgctctgttgcccaggctagatctgttgcagtgctgtgatcatggcttactgcagccttgacctcctgagctcaatagattttcccacctcagcctttcaagtagctgagactacaggagtgtgcaatcatactcagctaattttttaaattttttgtagacatggggggtctcccaattttgcccaggctggtctcgaactcctggactcaagtgatcctcctgcctcaacctcccaaagtgctgggattacctggatgagccactgtgcccggcctcaatatctttaaaaacagaaatggacacactctttgactaggaatgtatcctataaaaacacttatacacatgcagagacacacgagcaagcatgctttgtaatagcaatgaaggctggaaaaactcctcaatcaggtaaatgctgtcaagtgcacctgtgtactatgaaatggcacttggcttttaacaagagcaaagacagaaaagcaaaagtacaaagtagggtgtgatggcacatgcctgcagtcccagctactcaggaggctgaggcaggaagatcctttgagcccaggagttggaggccaggagctgggcaatagtgagaaaaaataaaattaaataataataataataaaataggctgggcacagcggctcatgcctgtaatcccaacactttgggaggctgaggtgggaggatcgcttgatcccaggagttcaaggccagcctgggcagcaaagcaagacacccatctcaacgacaaattttaaaaaatcagccaggcaggctgggcatggtggctcacgcctgtaatcccagcactttgggaggccgaggcaggcagatcacttgaggtcaggagttcgagaccagcctggccaacgtggcaaaaccctgtctctactaaaaatacaaaaattagctgggcatggtggcagatgcctgtagtcccagctactgaggcacaagaatcgcttgaaccagggtggcagaagttacagtgagccgagatcgtgccaccgcactccatcctgggcgtgagtgagactcctgtctcaaaaaaaaaaaaaaaaaaaaaacaaggagccaggcacggtggggtgagggagggcacagaagcagcgcctcttctgggggcacccccaatctctagcgatccagaggcctcaggatcctgaagggagaaaaaacgtgaagctccgtgctagaagagaccatagagattggaatcagctggttctattttacaaaaaaaggaaactgaggccctcagaaggtgagtgcctctcaatgccccacagggaggcagggagagggctctgagccctgcagggccctggattcttgcaatggggtggagtggagcctgtgccgcccccaccaggcaccttctcaggagaggagccgttgtcatatccttgaaggggtccttgagcccctcaaaaggctaaaaaccactttcctccttgagtgaaccttcacctcagtttaaccacaagaaaaactacattaaggcccagcgcagtggctcatgtctgtaatcccagcactttgggaggctgaggtgggtggatcgcttgagcccaggagttcaagaccagcctgggcaacatagtgaaaccctgtctctacaaaaaacaacaaaatcagctgggcgtggtggtgcacacctgaggtcccaactacttgcgggctgaggtgagaggattgcttcagcccaggaggtagaggctgcagtaagcggtgactgaatcactgcactccagcctcagcaacagagcaagactcaaaaaaaaaaaaaaaagcaggccgggtgtggtggctcacgcctgtaatcccagcaccttgggaggccgagcgggaggatcaggagatggagaccatcctggctaacacggtgaaaccccgtctctactaaaaatgcaaaaaattagccgggcgtggtggcgggtgcctgtagttccagctactcaggaggctgaggcaggagaaaggcgtgaccctgggaggtggagcttgcagtgagctgagatcacaccgctgcactccagcctgggcgacagagcaagactccatctcaaaaaaaaaaaaattaaatctcaaaaaaaattacattaaggcaaactaaaagatgtttaaaatatatatattaaattaaatacactccaatagagcaaatacgaaaatacccagaaaacacaatccccgcacccccaggacaacctcccagggggtccacagcaagagaccccaagcacgagagacagagaacagtgtccctgtggcggaacctctggcccatcaggctctattagaaaataaggctcttgccactgagagaaagaggcacagtcgcccagcagccacgggctctggcacaccacgagtcaggccagcaaagtgtcaactgccccctacaaggtgacaaactaggacaaactggaaaccagaggctggacctggagcacagggaccaccacatggggctggggaatgggcagggacctcagagcgccacccacatgcctaagagcagcgcgtatgcgcatgcctctgcatggcttagggacacagggagctccccccacccccaacccaggaaggcagcccccactacccaggtagggaacggataggaccagcaccccgttctgctcgtaactcagggctccaggccccctcgggggcaaccagcacagagctcagaccccaaatatcttcacccacctcctggtccccatctggacaagggtgctggggactggctctcagtcacaccctcggggtactcttcaaaggacagctggatgccccagggcaggagcttttggcccccagctccctcaccccagacaccagctcttgggaccccaccagcatgggcaaggtggacaccatcgtcccgattttgcagatgaggaaactgaggctgagggctggcacacggctctccagagctgaagagaatgcagagagcagccggagccagccggtgggtccctgaggccggctcgtagcaagccacagctgcctccgcccatcacacttggacctcactggccccaggacagccctccagggcggcctggcacagagcccacaccctgctgcttcctgaacaaataagtgaacaaggccaccaagccgaggacctggatgtagccccggctcccgccagggcctccccaacagactccccatttggagagcgcattaagtgtttccaaagcctcacaaaccacagatgtccggctgtctcacggcttctgtaacctgaacttggccctcactctgccctcccagcactcctctcagggcccaggcccctcctctgagatgccagcactgactccccaacttgtccccatcacctggctcgttcctgaacctcggcaggagagtctcaggccagatcctcccaccagccacctccaccaggatgcaggaggcatgagacctgctcgtgccggctgggagatgcaaccaaccaagatcaatccaatcagcggatgaactgacaaatataatgtggtccctccacacaatggaatattattcagccacaaaaagggctgaaataggccgggcgtgatggctcacacctgtaatcccagcactttgggaggccgaggccggcagctcacttgaggtcaggagttcaagaccagcctggccaacatggtgaaatcccgtctctactaaaaatacaaaaattagctgggcgtggtggcgggcacctgtaatgcaagctacttgggagcctgaggcaggagaatcacttaaacccaggaggcagaagttgcagtgagccaagatcgcaccaccgcactccaacctgggcaacagagcaagactccatttcaaaaaaaaaataaaaggctgaaacacccatacgtggtactacttggatgactcctgaaaacgttacagtaaccaaggaagtcagccacgaagacgcattgtaagattcccttcatgcaaaatgcccagaacaggcagaaccacagaggcagaaagtcgactggtgttcaccaggggatccggggagagggaacgggaagtcaccgtgtaatgggtatgggttttattttggggtgatggaaatctcttataacttgatagaagagagggttgtaaacactgtgaatgtaccaaatgcctgccttctatactttaatattttatattatataagtttcacctcaatttaaaaaaaaaacaactcgacacctttcacctaggaaagatctggctttagcttgcatttcctgtaactcctgcctaaagccttccagaagcttccgctgccttgtggatcacaaccagactccacaccatgatctggcctctaagggcctctcgcaggacaccccgagggtgaaggagcacccgtgggcccacctctgcatagctgcaaagcttctttccctgtcctcccctctacatgggaagctctgcccgcaggggcggggccttatctgccattctatcgcactcaaccctagcacttcactcggtagcagacaccaaagcaaaacagcaacagcattataccgggccaggtgcacgttaactcactgaattcatggtaggaaggattctattcccattttacaggtgagaaaactgaggcacacaaaggtagcatcagcttcctaagcctcccagcacaggaagcggccaggctggaatcagaccctgggcgcaggggctctgtccacagtgctaactaactactcctgcccccgagggctgcagcggtgagtgagtgagtttgtcagtggactggatgtccaaggtcatacaggaaaaatccagactattgtaataacagcctctagaccggctggggccagaaagatcgaggacgctgacacacaactgcgctcactgcagctctgccagggatggggctaaaggtctcacacagggcagttagggctccccatagcctgggagaggaacggggtgagataacagaaactaggtatggtgcccgaagtcaaacagccactgagcatgtaaacccaggtgggtctgaccccaaacccctccacccccatcagccctgcaacccgtcgctgcaagggagaaagcaactcagaggcctcacctgcctacatcccccacccgtgtgtgtgagttctactaaatgcctgagcagtgacacagcacggctgaaattaaacgggttccaaaaacgacaggaagcacgaagtgaatctccccaggaaagtgctgaacaaatgctggatcgggttcaccggcgaatttcttggaactgaagaggggagctaaacacacggggccctgctttggaggggactctctcagggtgctccacacagcacttggttaaccccactcagcccttctgggctctcccagagggcccggccttggccttgggcatctacaggaggaacctccagggggagagggggtgcctggacaggccggccctggaacaagcacttgggccccgaggagagaggactagggcttgggagctggggaagttctcagcactgggaccactagaacaaagccatttccgtgcgttcacagcttccaattgcaacaggaagcaatcaggaaaaataattagcggcccacttactggcttcgctgaggtccgaggcatgtatttcacacagtaaaaccagggatataacatcaaaaccgttctgcagaaagattcctccctttccttccattttaggcctggatcaccacattcactggggctcccaggccttgctgcctaatgttaaaataatcaactctatttttgcctcacacacaactgaactctacagctataattctttctcctcaggggctcgaaccacatggacgacaggcatttgactccagcaacatcaccccaaaacgtgcacaaaacccaaaactgcaatgaggtgaaaggcaacgcggtcggcctagaaaccccccctttaaaacaaacagtttccccaaaaccccttttgcctccttgacccaggcatttccggaaaaaggagcggcgctggcctgtactccccagatactgtcgctgttttgtcttcaccttgttttgctagctccagacaaggccccacaatgtaaacacgctcctgaaagaggcagatttggggtgaaactgtccatagaatctctaggcttgggtcagaggcaggaggacgtgaaacaaactccaagctcctcctgttccccgctgtcccccacacctccaagcagaggctgcagcctgggggatctgactacagggccaccccgctgcaccattcacactggaaatattcagggagacagctgtttgccttaaggaggcccagacaaaggggcccgaggtcctccccgctaaactgccacaaacagaacaggagccgcggcgtgcacaggcacttgcggccgtgccacttggccagccatactccagaaaaacaaaacacgcacatccgaagagaatgatttaggtagcaagaggcttgcttgaaaaaccacatggcaatctccaaattaaaagaacatgtgtagcgtttcacgactgcttaagtttcctgagtcctcctgacctcaactccaccccctgggaaacaccaaaagttggatgagaaagttcccccgccctacctctccccacgggagtgtacaactgaggcacaagcctgcctcccccactgccccgcgatctgggaccacgtctcctccgcgtagccgacccggggatggacactatctggggacccggcggccacacggggcattcgggtcgcccgggcacctggcaggtgtcagtccgcttggaaacccacagccacgcggctcacaggagcagcgccaccggctaggccgccccgcgcccgggctcagaactttctcgctgccacttcagcccgtcctcggagcacgcggggcggccgcgcggccgctggaaacaggcttgcgaaccggctccccgggccaggcccgcctccgcgccccaagtccccgctcggtgcccggcccgggccacacgggcccagcgcgggctcggctcggctcccggcttcccgcgggctcgggcaggtgaggacccgcccgcgccgcacctggcggagcgggcgccctcctcgccagcccgggacgcagcgtccccggggagggcccgggtggggagacaaagggcccgcgcgtggcggggacgccggggacggcagggggatcccgggcgcgcgccccaactcgctcccaactcgccaagtcgcttccgagacggcggcggcgcccgcgcacttggccgcggggccgcccgggccattgtccgagcaacccgcggcccgtcttacacgccgggcgcgggaaggtatcgaatcagg

SEQ ID NO: 8 - DNA, 33769 bp, Homo sapiens
  modified_base (33739)..(33739): a, c, g, t, unknown or other
  modified_base (33749)..(33749): a, c, g, t, unknown or other
  modified_base (33758)..(33758): a, c, g, t, unknown or other
cttccccttacactggtccttcgacccgcctcggatgaaaactgaatgggtttagccttagaggctctcggtctctaagggaggtgggtcaggatgccggggacagggtcctcttcctggggcaacgtgggggaacgagccacctacccctccactgaattgccctggggtgtgggtaccgacggctcattcggtgtccagggtctgagatgtgttgacaggaagaatgaaaggggatgggagggatggggcgaaagaagccacctgcagccccaggaactatctggccagcacaccgtcacccagcggcctgagccacccctgccagagccaggaggagaccctgccaatgggtcaccagtgtgcaggaactcagaaggtcatcacagttaataccctccatgccccaatgtgggaaaacaggttttttcacaacaaacaagataatttttgttattttggcaaaaggaggcagggcagccccggacacctccatcccacctcatcacccagccgcagggccccggccatccctgcagacagagtggatgtcacaacctccctgcaccgaaccaagtgcagctcccaggccacaggccacccaggaaaggtccagtggcccccggaggctcccaccgcaggcctcccaccacagccggcaccaacccaggatagctgtgttctcctggcttcttttcacacgggtagcagaaagctgagatccggggaaagctgagatccagggaaagctgagaatcggcctctgctgcccggacgcccacccccagctctgctcccagctccagggcctccttctcaggtgcccttacaggaggcagagggcttgagccacctcctgggcctggggcacgcaggatgaacggggtcacggtgcaggccactgtccactgcgcagatcccaaggccataaacagcctggccacagtggcttcccagctggcaggcggccagattatttttgttgtttagcaattgattaagtttctccgctgcccccaggggtaagtggtggggcaaatgccgcaaccgcagcatttgacccgggatcctgtgccaagtgaccatagggtcacaaagcacaagggaagtggctgggcccgatgctggctctgctggaacctgaggccggccactgtcacctgcacggtgcctgggaccttccagcaagcacagagaagctatggccctccaggagcagctggcaggcaccttggcctgcagtcaggggctctgtctgctcagctctaaaacaggaaagtcgctgctctgcctggggtcagggcagccagagagtgaccaagtcagtgccggcctcaggaagggacctgcaggcgggtcccttcctctcccatccctcggtgccagccagcccctcctgtggccccccactgcctgcctctgcccccatgccccaccacaacctcaggcccatggctgcatggccactccccaggcaggcagtggggatgggatttcaccatgttggccaggctggtctcgaactcctgacctcaggtgaggagttcctaaagtgctgggattacaggcgtgagccaccgcgccagccctccctgtggtactaaacactcacacccccttgctggggaccctggtgagggaacacagcctcacaagtgaagtgtggttttgttgagcaaatgacgcctgggcagccctctcatctttgcctaaaactgaagaatttaggggcgtggatgtataaaacagttggtgacttaaatgaaaaagaaggccacactcccccctttaggcaggcggcctaattctttaaaagccagcacagggtgcctttctgaacccaggcacacagtaggtgttcaatggacagcagcggttacttgtactgctcatgacaccctgtctgtggcctctgcagctggctccagcctgacgcatggctgcgcccctccgcaaggccaccccggtatacatggaaactctgtggagaaggccttgggggccggccaggacgccaggcccagatcccatctgcgcccttcctccatagacctcagcgagctctcggcaccatgtgcctcaggcccatttaagaagtagggccggccaggcatggtggctcatgcctgtaatcccagcactttgggaggcccaaggtgggtggatcacgagatggtcaggagatcgagaccatcctggctaacacggtgaaaccccatctctactaaaaatacaaaaaataagccgagtgtggtggcgggtgcctatagtccaagctactcgggaggctgaggcaggataatcgcttgagctcagcaggcagaggttgcagttagcggagatcgcgccattgcactccagcctaggtgacagagagagactctgtctcaattaaaaaaaaaaaaaataaaaaaaagaagcagggccagccacggacgacccctcacacagctcccaggacgcgtgcctgggtatagggctcaggaccatgaccgctgcagtggcccccaagaaacgttacttttgtcacccaccccgcctcagtggcagtagccaaaataacggattagaatggaaccatgtgacaatgccactgccccaactgacagaagatggctatcagcagttcacgcggccccacctatcacaagtgcagggcactctacaacttatgcatccttccccagacaccgtcctttcgaccctcccaggtcagcaaggcacacagggcctacatttcacagccacacagcagagggctgaggctggaactcggatgctctgatttccgttcaatcacatccccagaggtggcacagagacggggggcttctcttgacaaagtcaagaaagtcactgccagctccactgaagaccaaagaacctcagctctcaaaccctcttgaaggtgttaccgaactctcccagcctgtttcctgggtcccgatgttggtcccgtgggacacaggaagaggaagaagctccctagagcagagcctggtgcacctgccacactctcagagggctgcgcacgggcggaggagccgtgtgcaggagtggggtctggatggaggggcgctgtggccgggggcagggggcaggggaagggtgctccaggtggtgggcacagcacgagcaggggcagggaggtccacactcagatgtgcacagggagaaacaaatcgtgcatttccattggaataggcggtaaaaggtagaaaaacagagtgggggccaggaagggagtcggagccttctagtgtctctctgcaggtgagcggcagcccgaggtgtcagctcagcagacttggggtccaggggccgtgtcttctatcactgaccccagggcacacggaactggggagggagagcagaggcacagggcacggtcagtgaaacgaaacaaggagtcatcaccaaatgcggaaagggcaaggagtgcccgcagccgcacaagggttctgtctgggcaacgtgggcgtcccaccaggccccgcaccctgcaagcgcaaagctcgccactgaagataaagggaagctgttggagctgcggagctggtctggggtccgcatggagctgggcttatgctgcagtcacaagggggacatggaagaggctgcaggggacaaaaccagtgaccacagtctaactctgagcctgtggaaaggcgcccacagcattcacccatcccagagatgccattccccctgtgcccccgctccacggtgacagcgttctccaggaatatgatgcgcccctctcctcttgcatcagccctgacagtgagtattcaggccaaaaagcagaagagcacagctgcgtggttccatttccatgtagttctggaacaggcaacgctaatccaaggtgatagaagtcaggagagtggtggagggggcgggggttgaggatggcaaaggggcaccgggaactttcccagtggtagaaatgttctctgtctggaccgtgtggtagttatgcagacatatgcagctgtcaaagttaatccaaatgtacacgttaaaatgtgtgcgttttattgcctgcaagttatacctcaattaaaaaaataaagttagcactcaggcttcttccacaacttcctgaaccgtgtgagctgattttcttgctattaaaaattcacggtccatggctgagaacagcagctgccttctgtttgcaaagtcaacgccaatcactgcccggccgcggcagactcggccccacaggacctcctttcttttttccctttgacctacttccctgataagtgacaagacagccagactctgggaacaaacgcccgttattcggccccgagctgagcgggccctgcttcctgagctaatccgcccggacagacggagggacgtgaggggctttgccgtcggctccagctgtcagtctgcccgtcagactcgacagtggccccctctgttcctcccgctgcccccactccatccccgacttctttttgtttcctgtccctgacagacgaacatctgttaaaactctgtctgggtgagctgtggccagcggcccacaaatccccaagccgcaccccagcctcatctgggcgctgccgggagcactgcctggccaccctctggacatagctctgagagccaccggccagggcacgtgtggcccgagtggcatggtgcacgccgctaagcccactgcccaaaggcccccaagcaggagggatgtgcaggagacaaaagtcaaaagaacaggggcacgttccacagaggatggggctggaggggtggcagtgaggaacagcagcttccgaggatggcggtggcaactcccaaataaggcctcactcctgctgtttttagctcattccacataattggaaaaacatggcagaaaccgaagccagctgctgccttggtcctggggctgtgtggagggggtggggaggccggaggcccaggctctgcactcgactgctggggatgagagtgactctgagctgcagagagcagcatcgcagccgccatggtcccattgagccccggccacgctgggcggcagaggctcgtgggatatacctgccctgtctcatgggggtcacttcaggaggggcgggggagccaggacacagcccagggctagcggtcaccctgcagctcaggggccacgtaaatagtgccaccttgaaggcacacagcagtgcggggccccccccgccaccaacgcatccctacctctaggaggccgcctgtgtgcccctgggaacgctgctccctgtcccttggggtcctggtgtgaccaccctctcagccccttccttggggaaggcacctgactccctacacccagctggctttcatttgctcaaaatcaggaaaaagcagaattcaagacatcacagaaatgtcttcgcctgtaactccatgaaagataaacggtcagacacccaggagggagtcccagggacccttgagtctcacctgaggctctggcttcaaacctcgagatgtttccagccatgctagcgccgccccccacaacctgccccacacagtcctcccttgggaactcacagatttggcccccacctgccccgtttcttctggtggagtgggtgcgttgggttggggtggggctggggactctggatgtgtcttaagagtctgagtgattctgacacagccaggccctgcccccctcctgaccttcgccccacaggaaagggagccacacgcctgaagcgcccagcacacccccctccgtcctccccaggtcacccgctggccgtgtgagccgtgctccccactgccccttcacccaccccagctcctcctggcagcacccagccttggaagctacttctgattacaaccgccgaaggaagactcgctccctcggcactgacccagacagcctgcaccatcacgctgctcagcacaacccacacagccttcctccaaaccccatggagcggggagtataatcaccccctttctaccaacggacaaactgaagcacagagaggttaagtcactttcctaagctcccaacacgatgacaaaaaatagaaggtcagcccgcaagtggaactaggtgctccaagtccccggtctgcctgacactgcacctcctcgccgccacggtcccgggtccgcctgacactgcacctcctcgccgccacggtcccgggtccgcctgacactgcacctcctcgccgccacggtcccgggtccgcctgacactgcacctcctcgccgccacggtcccgggtccgcctgacactgcacctcctcgccgccacggtcccgggtccgcctgacactgcacctcctcgccgccacggtcccgggtccgcctgacactgcacctcctcgccgccacggtcccgggtctgcctgacactgcacctcctcaacaccaccacggtcccgggtctgcctgacactgcacctcctcaccaccaccacagtcccgggtctgcctgacactgcatttcctcatcaccacagtcccgggtctgcctgacactgcatttcctcatcaccacggtcccgggtctgcctgacactgcacctcctcaccgccacggtcccgggtctgcctgacactgcactttctcaacaccactccttggccggctcccaactacaaaccaagccatgtcttccatcctgaatcctcttggcctaaacatcactcacaatgcctccctcgggaacaggcacaagtcccaccagcacagcctccttcgttacctgcgtttccgctagcccagggccagctccagagccctcaccacagagcctctatccttcacccccggacactggacctcaccaacccatagcctggaggagatccctgtgtgaccccagggcctcctctgcccgactctgaatttcactgcccaacgtgacacctcggaaggctctctgggcactggcagccctccatgggcaccgctccttctggccagctctgacatcccggctggtgaggtgccctgcacgaggcctctgcccactgggacctcacagccgtgctgtcagctgcaacaagcgacagaatttcacgttttcttcacgttgcccctgggtgagcagctccaggtagttttcagtcgaggcgaggcgtcccgtcagcagccaggcggcacagctaattcatgcccgccgggcgcacggccgcaataccaatgggcacctgcagcctggaaagccacagaggaaccgagaacagcgactgtgctcaggtgacaggactgtggtcttttaacaaaacattttcctttaacgtgatattttacggcaaggaatgaaacctggagggcaggacatttggatactaaagccccaggctgccgcgtggtctgctttgtgaagtctgaagcccgcgccccattctggccccgctcacaggtccggctctgactcaccagcttcaatgctaggccgtgcctgtcctccaaccagaacatgacttccttaaggacaaagccgtttctcgcccatccccatctccctctggattaagaaatatgggaagatcttctagaaccacctcaaatttgcagagagccatcctggtgacaaacccttgaaatgcttctaagaagagtttaggtttcttctcaactctaaaacctctagaaaactctatttccacaccagctgcccctggaacacttcagcttcaaaagggcccagggcagggagacggaggagccagcatccacaccgagcaccagcctgttaattaacgggaagcgggtggggcccatctccaggcagctctgaggtcagactggggaaccatgcttacaaaaaaaagtgaactgaaacgctcacgtcctcatgcaaaaccagactcccagttgcatctttctgtctcattgaggagctttttcctccctttgacagaacaccctacacacggcatctggaaccaaagcagaaagattcaggctcagagtaaaacagtccccacactggctgcatgtggacgttcccggcccagagtctcgcccaagcagggcctataaatgacacaaaatgtttttctcctgcgtgccagtcatgctccaactgagttatgtgtaaaagtgcctctcacggctgagggcaaaaacagttcccacaagactagagaaaggtgacccctgacggctgagtctctagggagcgtggagctgcgtgctcagccctgcggccctgacggctctggaatggaaaagctatccaactggaagggcagggctcgctgctagtccagcggtccaaccccacaggtgtctgtggtgtcagctccatgccacagagcccagggctggggccagagccaccaggccccctgccagcctgcaggggcctcctcctctgggtagcctaaccaccccctgtgagcgcaggcagcctcctctaatcaccacagggcctgtccccccctctcccccgcttgcaggaaaatgagccctgaggactccccagggctgctctgggcctggacatggagactgggaattacatttgcagaaggagcgcaatgcccttgaagggctcagccacgagcagccagtccccagggctcagaaggcccagctgttagaaccctgggagccagcaaagagccaggggctccacctaagtctatagcccctgcctcttctggttgggaaagaaatcaacgcccctttactggctcccactgacagcccactcccccaggtatgggaggattctgggacgatgcaggcaaacctggaccctgagtgaacctgccccagctctcacgggcctggcaccagccacagcacctaaggcgccggtcatggtgacaacatgaaggtgataagggcatggacagtggacatggcagctggacactgggcacccactggatgccaggcacccagcacggctccgtcacccctggatgagcagtggccctttgcaagccagggtagcctgggcaagttatttgggggtctccaagcttgtccagctgtgcgacttcactgagccatgagtctgggattttatcagggcccacacccgttcctggaactctgatacgtgagggagccacacagggacccttaacaaaagctcccagggcaacatgttctcttgcctcagtctcccaaatagctgggattacaggcgcacgactaccgcccggctaatttttgtatttttagtagagacagggtttcaccatgttggccaggctggtcttgaacccctgacctcaaatgatccttccactgttagggcaaggcacctgacaggcacgactgcacgatctgcttgttgggggctgtgtccattccccactccttcgacaaatgtccacacccagccttgctttgacaccccaagaacagagatggtgacacctgcttcctacatgcccattgctctcccaaggcagacatccccagcagatgcaacacagtgtttaggcagacatcaccaatcgatggtggcaacagacaccaggccctgctccctctaactccagtggccaggccccaagccagctctcacctgcccactcccaacccacagcagcaagactcagaaatggcaaaaacacaaagagaacagaaacgccccatagcgggaggatgactaaaagacatgtcttgataagatattgttcaggcataggccaggcacagtggctcatgcctgtgatcctagaactttaggaggctgaggtaggtggatcacctgaggttaggagttcaagaccagcctagccaacatggtgaaaccccatctctactaaacatacaaaaattagccagacatagtagcgggcgcctgtaatcccagctgcttgggaggctgaggcaggagaattgcttgaacctgggaggtggaagctgctgtgagccactgtactccaacctggacaacagagcaagactctgtctcaaaaaaaaaaaaaaaaaaagatatccttcactaaaactcatgtctttgatacatatttacctcctgcaatcgcaaatgcttctgcagtgcataaagtgaaataaatagcaggaagccttacggttcgatcacccacacagacacacagtcacatacaggaaaaacgcagggagggctggggaacaaaaaaacagaagataaaatgtggagacagacacaccaagagagtaagagaccacctccagacctcccttcagcttctcaaacacacgagccgggcccgttacagaatttgcggggaccgctgcaaaatggaagtgcagacagccccttactcaaaaggtaggaatttcaggtcaacaacagagctcacctcatatgactacacaggtcacacagcccgtgaagtcggtcccaacaccagcatgctcctgcctcaaagccgctgcacgtgctgttccttctcgcctttccctcttttagtccttcagatctcaggcctcctgagagagacctctgacctgccggctcaggcggccacacccccagtacaggagtctccggctcagcccctgctgtgttccgtacccgatccaggtctgtcctatgtccatctgtgtgccggcttgcttcctgacatggcccccaccacacgtgtgcctcggggcaggggaacaggcccgtctcattaactgctttcttctcagatattttctggaatatttgtggatattgggcaacatatatgctccacctttttcagactagccaggacgagctgcatttttttttttttttttttgagacagggtctcactctgttgcccaggctggagtatagcggcatgatcttggctcagtgcaacctccgcctcctaggctcaagcaattctcctgcctcagtctcccaagtagctgggattacaggcccgtgccactactgcccagctaatttttatatttttagtagagatggagtttcaccatgttggccaggctggtcttgaactcctgacctcaaatgatccacctgccttggactcccaaattgttgggattacaggcgtgagccactgcgcccggcccgagctgcctgttttacacctttgccatattccggtgattctctctcccctccgtcccccggccctgactgtggtggccactccctgccgtcatgagcccgtatgtcctcactctttccctttccgccaggacttcaaccaacactgcagagcgcagggtccagctccagcactgagttcagcctcttctcaccaacagacaggcaggaaagaaaacaaactctgagaaggccaaggttcccgggcagccagcaagccaagcatccttctccgctgaggcttgtgcagccgaggcaccccctcctccagggagcaggcagcgtcctggggcagtctgcgagggagaccagggcccttgctccaccagggccccaggtatgggggcagcagcaaactcatggctctgggagccagaccccacctgctagaacctactatgccacctgctgtgggcaaccccaggctggtgacttgccctggcctcctctgtaaacaaagggctcatccaacctggtcaaaccactcctccccttcaagggtctataatcctcccttaacctgcttggtccaaacccctggtgtcgccaggtcactcaggaggcagctcatctggactccttccctgggtccagtttctctctcaacattgcctttgaggccgaggtgaacggtcaacagcgaagggccccagaggtgatggaggagcgggtgtccaagacactcaccctttctaatgcactgactccctcgtggactcacttgtgccgtctcccccacccacccagccccagagcccagagtgcgagcgccagaggcccgggattctgtctgcaccgcggggtccccagtgcctcggagcaatgccagcacccggcaagtgttcgacaaatgcctgctgaatgagcaaatggatggatgaacgaatgaatgagcaagcagatgaatgaatggggtgctgtccagagccgtgaggactaggccgcccaagtccccatttctcaaattctccttctcccgacttgggaaacaagatgcttggtcggggaggctctccaaccatcccctgcagcagccggcacagcggacagaccctttgatgtaacagccatgtcttcattaaagatgccctgctctcagaaagagaaagacaaatacaaacctggaaaatcctcaccaaacgcaggacccctgccagggagcagagaaaagacccacacgccacgggcgccacgaccacacacacaccccagccgctgcacacaaacacagaccctagccagcaagaacagggggaccaggaaactgttcctaaagtcaggacccccatgtgctcagacagcagtgagagcaaggacacttctccatccaccggatgccaggagagtccttttagggggccccacaccgagactctgcccttaggactgttcctgagtgtggaagccagcccacttggaagccccctgccctcccgagtgggacaccggcacaggaagcaggccctgtcccccaccactttctgcaagctgggccccatcacgctacagaaacggggaggactggtcccagggatggcgctttcctgacacctctcgttaccccctcgcttgccaggccccagggtcagccccagaggccagactggctatcccaggcccgggagcatccccgaaggcgagctgcatcctgaacgtgtgtgatttcccgaagggcccgccccgaaccgacacctggaaagaaagatcctcagccggtgccccagaggagaagagccatgcctcactgcaacacagtcccaggaagcaccaagtgcctgaggaccaaggcggagagtaaaaaagtggaaaatatctggggcaaaaataaaacaaaacaaaacaggattgacctcctgggctcaagcaatcctcccaactcagcttcccgagtagctgggaccacagacttgaatcaccacacccgccaagtggatcatttcgaacgggtttgccgaggttccttctggggcacccccggcggccgcaacccattcccgccaggccccgccccgcccgcccgccccgtcccgtcccaccgcctcacctgccttacacgtcctgccgttgtcctgcagctgcacacccgtggggcaggcgcatgtgtagaaaggctcgcttggggacagcaggcacaggtgggagcagccgccattgtcctcctcacagcgagtgtggactgagaaaaccaggacagactgagagaaggttccagaagaggaccgtcacttgtttctgaatgagtcacatcctgcctcgtcccccgtgacagcctccagtgtgtccctctgcccaaacatcggcctcaagtggcatcagggacctccccgcgggcaccattccacctgcctcatcgctggccccgtccacatggggccctcagcctggccagacggcctgcaatttccccaaaaccagccgtgaccttcctggccaccctcacacccagatgtgacctgcccatggagtgacatcctccccatctgcttcctcccaccaagctcctatgactagaacaccctccccagctcctcggagcccccaaaggacacccctctgcaaaggctgccccccacgctccaatggccggggtcaggacctgcctgtgtggtagtgacgggaaccccagagacaatgggctcctgggcaaaaggcttgtcttgtctttgtgctatgtgtggacccagcagcttccataggaacactgtccttcttgctgggatggccaagcttgtcactctcccaagccctcctatgaccaacagcaattgaacggaactcgataaatgcttccagcacctcattcaaaccaggggaaagctgggtgtagcagccccaaaatacggatataactggaacaacaaactcatcaaaatgaacctctccctccctcatgctgccccaagtgtagatgggttttgtgaccacgactttctcaccaggaaacagctccagagagccccaccctcctgtgtcctgctctgggaacagctggcacccctaggccccacatttcaattcaaagtccaaaccttccataatggcctggccagaaatctccatccctggtccctgtgggagtgggccactgtccccagagccgcagccccactgtcacagaagctggtgcatttccccatcagggacctctgtcacaacccagcgtggcccccaggctgagaactgctgattctgggcagattattcattgataaatacgcgacttgcagggccaagcatggtggctcatacctgtgaccccagcactttgggaagtcaaggtgtgaggatcactggagcccacgagtttgagacaagcctgggcaacgtggcaaaatctctcatctctattaaaaatacatacacacacacacacacacacacacacacacatatatatgtatatataaataaccatatatatatatacacacatacgtgtatgtgtatataaatacatatacacacacacacagacaacttcttctgggccttgaaaacgaggcaaccttccttggaaatccccttgccactgctgagcctgaaatagcccccatgagctctgcagaggggtcctctgcaggcccgtgtcccccagccagccacacacctccctccattgcagcaggtacccctttagagagggggccccccagagcatgggcttctgcagggaggggtcacctgcccccccaccccacccacgcccgcgcacccccacgcccccgcatcctcccactcccctgccccgcgcccccgctccccccagccccctcaccctctcccccgtgccccaaccggcactcacaaaaaggctgccgctcctggctcagcacctggatgtccatgggtgagtatagggcactcaggatctccttcctcttccccccagtgcgcttgttgcaggcatggatggagcgggtctgccagtctgtccagtacagagtgtccccggagagcgtcagggcgaaggggtgcgtcaggctgccctccaccaccttctgcctgcagtcagggaagcggggtggaggagccatcaggagggtcccccgacagtcattgctgctgacccaattaatttctttttttttttttgagatggagtctcggtctgtcgcccaggctggagtgcagtgatgtaatctcagctcactgcaacctccgcctcccgggttcaagcaattatcctgcctcagcctcccgagtagctgggatcactgatgcccaccactacgcccagatgatttttgtatttttagtagagacagggtttcatcatgttggcaaggctggtctcgaactcctgacctcaggtgatccacccacctcagcctctcaaagcgctgggattacaggcgtgcgccaccatgccaggcttcccatttgctttcaaccagacaagtgaggccaggtcaagagccccaggagctggcgccctcgtacatttctcccggcgtgcacagggcacctcccaaacacagcctgtgatggtgacacacgggctcccccaggtcaagtggcaaagtctcccccagggaagaaaggaggaagccatgcctggcaaaaagcacacctctcctgcccaacgctttaacctctgtatacaaatcaggccatgtgcactcgctccttcttacaatgctcataatttatactttcagagtaaatgaaacttggcatcaacccgagaaacagctattcttttctagatgcttacagtgcccagcaaatgaggactcgggtgtaatgagattatggacactggaaacaggatcataatgtgacgtggtcggtaatgtgcagttttatttgcttaatgaccctcgccccgtgacaggctccctgagggtgggcctgggggcagaggtccccgccacgtccccagccctcagcacagttgccaggagagggtgacactcatgaagtggcacagggaagatgggagctgtgggctctgcagatccaccacctcttctgttcatttttgttgatgctgttttttaagaaaattattgaagtaaaattcacaggacatacgtttacttttttttttttttttggagatggggtctcactctgtcacccaggttggagtgcagtggtgtgatctcagctcactgcaacctctgcctcccaggttcaagcgattctcccacctccgcctccagagtagctgggaccacaggcgtgcaccaccacacccagctaatttttggggggtatctttttggtagagacagggtttcgccatgttgcccaaggctggtcttgaagccctgagctcaggcgatccacccgccttggcctctcaaagtgctgggattacaggcataagccactgcacccagcctaaatttaccactttaaagtgaatagtgttacctagtgcattcgcaaggcggtgcagcctccacttctgtctagttccaaagcacttccattgccccacaggcaaaccccacacccggcagcagtcatgccccagtccccgcccccagccccggcaaacacttttgatggacttaactacacacattctcaacatctcatataaacggaatcacaatatacagcctctgatgtctgtcttctttgacttggcaccatgttttcgaggttcatccaggctgtagcatgtcagtgcttcatcccgttttaggggtgaaccatattccagtgtgcagacagaaaccaatctgtgcatccattcacccactgggggacctttgtgtcatttccaccctcggctgttgtgcacagtgctgctacggacattactgtccattcacattttgtgtgaagacctgttttcgattcttaagagtatacagctaggagcggaattgctgggtcatacgtaaatcaatgtttacgtctcaaggaatcaacaaactgttttccacaatgttgtcttttttgtttgttttctgagacagggtcttgctctgtcacccaggctggagtgcggtggtgtgatcatggctcactgcagcctcaatctcctaagctcaatccatcctcctgcctcagcctcctgagtagctgggaacacaggtatgtaccaccatggccagctaattttctaattttatttttttttgtttttgtttttttgagacagagtctcgctctgtcgcccaggctggagtgcagtggtgccatctcagctcactgcaagctctgcctcccgggttcacaccattctcctgcctcagcctcccgagtggctgggactatagtcaccggccaccacgcctggctaatttttttgtatttttagtagagatggggtttcaccgtgttacccaggatggtctcgatctcctaacttcatgatccacctgccttggcctcccaaagttctgggattacaggcgtgagccaccacgcccgaccttacttttaattttttaattttattattttattttattttttttttttttgagacagagtctcgctctgtagcccaggctggagtgcagtggcgggatctcagctcactgcaagctccacctcccaggttcacgccattctcctgcctcagcctcccgagtagctgggactacaggtgcccaccacgatgcccggctaattttttgtatttttagtagagacagggtttcactgtgttagccaggatgatctcaatctcctgacctcgtgatccgcccgtctcagcctcccaaagtgctgggattacaggcgtgagccaccgcgcccagccttttttttttttttttttttttttttgagatagagtcttgctctgtcgcccaggctggagtgcagtggcgggatctcagctcactgcaagctccgcctcccaggttcacgccattctcctgcctcagcctcccgagtagctgggactacaggcacccaccaccacacctggctaatgttttgtatttttagtagagacgaggtttcaccgtgttagccaggatggtctcgatctcctgacctcgtaatccgcccgcctcggcctcccaaagtgctgggattacacgcgtaagccatggcgcccagcccatgtggccatttttcagtgagagaagccagaggcccatcactctcggttgctccctgggccatgctctgcctcagccagaagcactgagggaaggtcagcctcggcccttgccccagccacagtcacagataaaggggcctgcacaggtctgtgtggctccagagctcgtcacccaacacacgacgcttccatgtgaatagccccaggtgcatcatgaagagcgatggccgctgcagaggcagaagaatcccgcggggaagcaggtgggagagaggctgagaacagaccagaccctggagctacagaccctatgttccaaccctggctgggactagctgtgtggctctgggcaaattcacatgcttctctgtgcacaggggatcaaaatagcaaacacaggctaggcacagtggttcacacctataatcccagtgctttgagaggccgaggtggacacatggcttaagctcaggagtttgagaccagcctgggcaacatggtgaaacctcgtctctacaaaaaaaataccaaataaattagccaggcgtggtggtacgtgcctgtggtctcagctacttggaaggctgaggcgggaggaacacttgagcccaagaagtcaaggctgtggccgcgtgtggtggctcacgcctgtaatcccagcactttgagaggctcaggtgggtggatcacttgtgatcaggagttcaagaccagcctggccaacatggtgaaaccccgtccctactaaaaaaatacaacaatttgccaggcgtggtggcgggcacctgtaatcccagctacttgggaggctgaggcaggagaatagttagaacttgggaggtggaggttgtagttagccaagatggtgccgctgcactccagccagggggacagagcaagactccatcccaaaaaaaaaaaaaacaaacaaacaaacaaaaaaagaggtcaaggctgcagtgaaccatgattgtgccaatgcactccagcctgggtgacaaagtgagaccctgcctcaaaacaataaaaatataaataaaaataaaacataatagcaaacgtttcatagaggtggtatgagcattaaatgaactgataaacgtccctggaaaacagtaagtgctatggaaggattcgctgccgccaccgccaccaccattagcatgtttcaacctccatcaccctcactgtcccctgtcaccatcctttgaccagggcactcccagctgcagcctttctatcctcttgtccacccttcataactgtaagatcactcagctcccaagaaccacagtctacagggtaaccacatttccaaatctcaaaccagacccgctggtctgcacttccagggacaacaggatattttcaaaccagcccaaaagagatgtgtggctcagcataagaggaacaggagaaactgaggcctcttgccctgagaatgagcttggaagtggatgtcccggcctcactcaaaccttcagatgactgaggcccagccaggagcttgagtgtaccctcaggtcataccctgagccagaagcacccagctaatccactcctcatcactgactccctccccataaaaaacctgtttgctgtttcaggctgttaagttgtgggctgttttgttacacagcaatggataactaacacacgaggcctggcaagtgtggagcaaagctgcccaagccctcaagtctgttcatgtgggtgttggcctgtgtttgcagaaatccagccactgagtcctcccatgcagtcactactgccctctgcacagacacctgccacatccctgcctgggccaggagctccactagtgcaggaatggggtctgccgtcccaggaggatccctgacacctagcacagggctagcagcaggcagcacttggttagtgaataaactgcccttcacctgtacacagaagggatgtttctataaggggtaattaagtacagagctgggaagctatgctgaccagaaggctctaaaagcaattaaccaacgaggggaaaacccttcctactcattctcggcccattttattgagcactgaccatgtggaaggccccctggtgagactggggaatgcaccaataactgagacagcttccggctgttgccctcaggatgcctgagctgggatagggccagggtgggggtggtgcgtgtgacagggttactgttcacaaccctgccgggccataagccctccccaacaattccaaaatccaaaacgctctgaagatggaaagcttttgttgctcatctggtgacaaaacctcatttggtgcatgggccgggtgcggtggctcacgcctgtaatcccagcactctgggagccgaggggaaggatcccttgagcttaggagtttgagaccagcctgagcaacatgtgagaccccgtctctaccaaaaatacaaaaattagccaggtgtggtggcgcactcctgtagtcccagctactcgggaggctgaggcgggaggatcgcttgagcctgggaggtgggggctgcagtgagctgagattatgacattgcactccagcctgggtgaaagagtgagactctgtctcaaaaaaacaaagttaaaaaaaaaaaaactgtgcatgggtgtgggctacagatagtcttttctgccctacttagaatgaacgtgccacatttgctatagaaatattcaagggctggtggcaaatgccacacagaccctgacgctgttccaagttctgagaagtcctgcattcctcagggccccagagtttcagagaagagtctgtaggcctgagttaagaaggaacgccttcaaaagccctggggacaaaggggaaaggggtgccccaggactgcgtgggtacctaccggaacgagccgtccaggttggcacggtggatgaagctgagcttggcgtcagcccagtagagcttctgctcctccaggtcgatggtcagtccattgggccagtaaatgtccgagtccacaatgatcttccgggtgctgccatccatccctgcccgctcaatccggggcgtctcaccccagtctgtccagtacatgtacctgtgacgggggcagggcaagagaagcagctaacacagatctgttttttgtttttgtctgcatagatgcagacatgaaacaacagacagtgaacttgccctaaaatctcacccatcggaaataaccaacaggtatggtttcaggtattcctgccttaagctgggcaatcaaaatatactatttccaacttgttctcagttaacagtaaattctgggcaccttcccttcttgtggatagaaagattccttgttcttttgatgattgcctagtgtactctgctgtaagttttttaaagaacttcaggttatttctgatttttttgctaccatgaaaatgctgtaaatgaacctctaaaaggcaattcaaaacactcaggatggaatattatttagtggtataaagaaatgagctatcggctgggcccagtggctcacacctctaatcccagcactttgggaggccaaggcgggtggatcacgaggtcgggagatcaagaccatcctggctaacacagtgaaaccccgtccctactaaaaatacaaaacattagccaggcgtggtagtgagcacctgtagtcccagctacttaggaggctgaggcaggagaatcatttgaacccgggagggggaggttgcagtgagcagaaatcgcaccattgcactccatcctgggcgacagagcgagactccatctcaaaaaaaaaaaaaagaaaagaaaagaaatgatctatcaagccatgaaaagacatggaggaaacttaaatgcatgttagtaggtgaaagagccaatctgtatgagtccagttctaaacactctggaaaaagcaaatacacagagacagtaaagcatcagtggttgccaggagttggagaggagagggatgaatgagtggagcacagaaaatcagggcagtggaactatcctgtatgacatggaatggtgggtgcatgtccttactcatctgtctaaaccaagaatgtacaaatcaagggcgaaccctcgtgtaaacgtggattttgggtgatggtgcgtcagccagctttcatcagttgtaacaaatgtaccaccctgcacaggatgctgacagttgggaaggctgtgtgggtgtgaggacagggatgtataggaactcagtacctgctgctcatcaattttgctgtgaacctacaactgtttgaaaaaattaagtctatttaaaaacaacaaaacatggccaggcacgatggcttgcacctgtaattccagtacttcgggaggctgaggtgggtgggtcacttgagccaccctgggcaacatggcaaaatcccacctctacaaaaaataaaaattaaaaaaaagttagctgggcatggtggcacactcttgtagtcccagctacttgggaggctgacgtgggaggatcccttcagccctgggaggtcgaggctgcagtgagctgtgactgtaccactgcactccagcctggatgacagagtgagaccctgcctaaaaaaaaaaaaaaaaaggctgggtgcggtggctcatgcctgtaattccagcgctttgggaggccgagatgggcggatcacgaggtcaggagatcgagaccatcctggctaacacggtgaaaccccgtctctactaaaagtacaaaaaaaaaaattagccgggcatggtggcggacacctgtagtcacagctactcgggaggctgaggcaggagaatggcgtgaacccgggaggcggagcttgcagtgagccaagatcacaccactgcactctcagcctgggagacagcaacactccgtctcaaaaaaaaaagaataaaacccatggctgggatggaccctgaacctgcagctgcagctgttcctgggtaggtctgtgggcgacgtggctttgcttctccatgttcccaagagacaagcatcacccatccatgagaaacaagcacatcctcagggcgcccttacgtgatctctggccaatgaaccaagacaaagtgagcagacaccaggtctgggatggcaggtcccacccccaccagtgcccagtgtgccctgtttggaggtgaccacagggtgtgtgcccagaggctgggcgtgactctcagcggagaccagaggggaaccacaccagcttggaggactcagttcccatcccagccagctgggatgagccacaggacacaagggctggcagacctattgtgttttgtccacccttcacagcagagaaaggggacagtgcccagaatgtcctctgaggagcctcctcccactcttggtccttgtaaaatggtgctgactcccttgctcccttcttcctggggtgggcggcaaaccccattcccctcagccttagcaagtgatttagaaacaggcagctcgcccaagccaggcatgagagtgatcccgggacacagggagaacaagccccgctttgccctctgggggtctccattcagcagaagaggcaaatgacagacacacagccgcctcctcccccaccatggtgctctgcagcctcaggagcctcaggtgcaccaagggccaccccatccagggggccatgcttccttgagtggtatcgttcctgagcgagtaccatctccaccttccagaggggctgtgacaagatcaacaagaatgagggcataggagcctcgaaccaaacatgccctcttccctgcagaggctgactgcgcccagctgctatcaccaagcccctgctcctccggccccgtggggacagggtaagaggggtgtcacatggaacagctctccaaacagtccctctcaagctgctgtctcctgtgcatctagtgagaacccaaccaacaaagggaaggtgggaattgctattcccattaggcagatgagaaaactgaggccccgaaaggctggcctgttccaggttacaggcgctgagcggctgctctgggaacacacttggtgtctgctgagggcccgagcccggccatcatatgactcacccttcgccagcaaagcccgggtgtgggtgaacttttcctggcagcctgggactccaaggtgctggcagccagcccagggaaggctcccgcgtgcctgcggcagacgccttgctttacctgcacgtccccacccctaggagcctggacagagcccagaccctccgccacctcctgagaaggtatcaggggcatcagtctggacttgggggggaatccacacaggccttccccaaatgctccaccgtggcccatggaaaaggctggaaaacgtgcaggagcaggagcctccgcatggagcataattcacattccttccccgagtttcataacagaggcctgctggtttccttaaatggggaatttgcgagccagtcggtgaccagagactggttggcgtggacgtgctcttgcagagtctcaaacgctaccacaagcccagccaaattccacggaggaaaatcgacttccgaagaaaagagctgcagcatggccttcgtgcagagccagctgcggttgtggttgtgtgttattttagggaagggccattttgcattttaaagagggggttgggtttcaccctggctttaatttgagacccgggggccactgcagccccttgtcaggctggtacaggccggggactcctcccatgctaagccagtgtctttctggccccagatcctcaggggccagagggtcatccccagagcccgctctgccacccacatgggtaccctgggcctgggagggatgtgccttccctcaaccctgcctggatgtccgcacggggccacctgcattgctgaaactgcaacgaagtcgagtctcaggaggggcccccctggctgcagggctcttgatccttttggccacgtgcacactgaggtggacgctcggacccagagacccccttcatgatgatggccggggcaggaaccccctcctctgaggaaggaccctggtgggggacagcactgcaggagggcacaggagatgacgggggctctagcagggccgggaggaaggccaagatgctcctcgcaaccgtgtgcctgtggccaggacagaggacaaacccaccctccactgtccccactctcaggacagcagtcctgccccaggactcagcgcccacacttatgcctgaggaccactattcaagtcagtatttggcgagcaggggttgctgccgcgggcgctgtgacaggctggaatcctctccctctccctctccctctccggagacatggagcctacagggacagagtcagcacctcagggtaggaccatggctggcgtcatcagcatcactggatctgatgagtgggagccggcatctcactgttttcactctctcattcaaatgactggagcaaagggaaggtgtggggagaggcccaggaatcaacactaaggtcaactttgcccccaggggcaggggtgggagtgaacagccacaggtgtgatcctggggagggcttctgggagagaattcagaggcaagcatgtagaggaaccatttcaaatagttaagaaaagccagagccaaacagggacagttggctcgcagagatgatgcaggcaaagccagctcagatctgagcatgggaaagactactcccaaccaagggcccagcatctcccaaccaagcaccaagtacctcccaaccaaatgccaagcacctcccaatcaaatacctcccaaccaagcacctagcacctctcaactggacaccaactactcccaaccaggcaccaagtacctcccaaccaagtgccaagcacctcccaaccaagtaccaattacctcccaaccaagcgcctagcacctcccaactgagcatcatgcacctcccaacagagcatctagcacctcccaactgatcacctcccaacctagcaccgagcacctcccaaccaagtgcagagcacctcccaaccaagtgccaagcacctcccaatcaaatacctcccaaccaagcacctagcacctctcaactggacaccaacaactcccaaccaagcgccaagcacctcctaacaaagtaccaatcaccttccaaccgagcacctagcacctcccaactgagcatcatgcacctcccaacaaatcacctagcacctcccgactgatcacctcccaacctagcactgagcacttcccaaccaacatagcaaaagccataaagaagtaaaaagacaaaaccacgtaggcatggagactggacttctggtggcgaggaaagggcatttttattataacgacagctaacatttgttgaactcacaaactgttcttggtgttttcctcatgacatgcagcatggtcacgcctctgtacagacaaggatactgaggcacagagtggcaccgtgccaaccttgtctcatctttttatcgaacctacatgcagagtgccagcaaatccagctgtcttttctcttcagaacagatcccaaatctcgccactccttacccccacaagtgaggtgtccccgctgctgctttctgtcgccaggatcccggtaataaccgtggagagggctcctgcccccacgccacccaccccacagctcactctcgctccagccaccaggggatgccttccagcacgagtcagagctggcacctcctctgctcgagacctcatgtgtcctctcctcacaccttgggccctgtttccctacattctgctacagcccctcaaacaggccccgccccaaaccagcccagggcctttgcactggctgatccctctgcctggaccgcgctgcccccagacagccacacggttctcagcctcatctgcttccagtctcgactcaaaagtcaccaagaggccttcccagcacctgagctccgacggaagcccctcgccacagcacccaagcactgctttatccccctacgcacacgtccctttcaaatactattcatttaccatctcctcccactcactgaaagggccagagactgggctatacccgctgcgtggggagcaggaccaggcgcaagggctcacaaatgcagtggatgcctggttgggaggtgagggagctgcagcgacccacgctgggagggaacgcaatgacaggaggagcgcaggtcctggcgacacgatggccatggcagccgctggtgagcaaccgcaggccggccctgggagagggcttctagcaagctgctatcttcagcctctccgactactgcagatgccccctcctagccagagacactgctacaccagccgacccttccaaaaagaaggtcagtaaccccgcgactcctggagccacagtgcagggggagagggctgagagggcaacagttcaccaagcggaacagaggctgccccggaggtcagctggctccccggcagctgcaggggtggctagcccactcggagggcagcgagggcatacgaggggctccagggatgagtggttgcccagcacagcacccctgggaggccgggggcacttctcaggtagtgggggcacgaggctgctctggcctgacctcagggactcaaaatactttggcgataaattccaccgtgtcccacccctgctggtaccccatacttacacacagactggttcagatgcagacactctcgcgcacatactcgctcacacgggcacatacacgtgcacacacagtcacatgcgcacactcatacacacacaaatatccactcacacgcatgcatgcacacacacggacacacacaggctcacacgtatgcacgcatatgcgtgcacacgcacacacacacacacacgctcacatcctcccactcccacactcagttgctcagacacacacacgcctggctctcacacaaacctgttgggctctgaaaggctccagcccttcccatgctcgtcagaagccagtcaatggcttcctaagtcaccacacagatcaaagaggtgaacttggccacatggcactctgcttcctgagctcccaaacaccagccttggtgaggacagaccctcaccccacaccctcattcccactaccctgggcaggcccagaggaggggcatctgcaggatctggcaaccagcccctcccgcccggctcctgcagccggcaccatgggagtcagggggaggtcactgcaaagggcaacagcaagttggtggccccaggactagagcccaggggtcttcagtcctactccagagcttggacactgtcccacagggcatggccaagggaagggcttccagagccctgacttcagggaggagggcaggcgggctcctgtggcaggcctggatgcatggccgcccactcctgggactttctaacctagaatatctaggtcaggctgggtgcagtggctcacgcctgcaatcccaacactttgggaggccgaggagggtggatcacttgaggttaggagtttgagaccagcctggccaacatggcgaaaccctgtgtctactaaaaatacaaaacctagccaggtgtggtagtgcacgcctgtaatcacagctactcaggaggctgaggcaggagaatcacttgaactcgggaggtggaggttgcagtgagctgagatcgtgccattgcgcaaagaagatctaggccggcccctcaaccggtgaggtccaggctgggagtgctgagagactgtggtgacactgaatgaactaacaggcaaagggcttccaactgagcctgggggtggtgggaaatggctcttgtgttctagtcaagacctctgccaaccagttctgacactgacccagcacagaacctgacaggtcagcaagggccagggcttagcacagcccaggtaagggtgtgtgtacggcccccagagtcactcccaggctgcaagaaaagggacaaaggagggacaaggggtggccaagcaaactgttccctctgctcgggagtctggggtgacctggcctagctggccagtggagctgggccacctccccttaaactctccaccccggacttcgactccaaagctttcctgccacccacgctctccccacctgggatcacggccaggccctgagccttcaagggcccaggtgaactcagccagactaggagctgaggaggacacagggcagcttccagaacggacccgagaaccactcccagcaggttctgcttccagacaaggagctgcactttttcagccaatgcaattagaaagccaggagaaggtgcaaattccacctgcctgagcgtccgcacttcccaggccgcccaccatacacacagcaaagatgtgtttaaccattcaaacccatggccaaccacatcggttgcctcagacatgcaagttttaaaaaggaacataactatgggccaggcacggtggttcacgtctgtaatcccagcactttgggaggccgaggtgggtggatcacctgaggtcaggagttcgagaccagcctagacaccatggtgaaaccccatctgtaccaaaactacaaaaattagctgggcgtggtggtgggcgcctgtaatcccagctacttgggaagctgaggcaggagaatcacttgaacccgggaggcgaaggttgcagtgagccgagattgtgccactgcactccagcctgggcaacaagggagactccatctcaattaaaaaaaaaaaaaaaaaaaaggaacataactatggagtctcaaggggaagtaattccttcaacaataacaaatcttgaaagctgagctcttttttttttttgagacaggatctcctcactttgtcgcccaggctggagtgcagtggtgggatcacagctcactgcagcctcgatctcccaggctcaaatgatcctcctacctcagcctcccaagaagctgggattacaggtgcataccatcacacccgattcatttttgtatactttgaagagatggggtctcaccatgttgcccagtgtggtcttgaattcctggactcaggtgatctgcccgccttggcctcccagagtgctgggattacaggcctgagccaacacccccacgggttcattttcagagtcgcaccgagtgctggggttacaggcctgagccaacccccccacgggttcattttaagagtgacaccgagtgctggggttacaggcctgaaccaacccccccacgagttcattttcagagtcgcaccgagtgctggggttacaggcctgagccaacccccccacgggttcattttaagagtgacaccgagtgctggggttacaggcctgagccaacacccccacgggttcattttcagagtcacaccgagtgctggggttacaggcctgagccaacccccccacgggttcattttcagagtcacaccctttttctgaaaaacaacttgggctcatgcaaattcgagagagagatggtgacactccccgccccctggacccaggtggagtcgcagcagggtttacccgtgagcggggtccaaggcgatggccctcggctggtcaaggtcctgccagaagagcaccttccgggatgtgccattgaggttggccacctcgatgcggttggtctctgagtccgtccagtacagcttcttgcccacccagtcgcaggcgaggccgtcgggagagaccaggccggagatgaccacgttctgcacggcggcccccgtctggttcaggtaggtctgcttgatggcctcctcgctcacgtctgtccagtacacggctcccttggaaaactggaagtccactgcggccgcatcctccaggccgctgaccacgatggtggactccagcttgactccgccggcgtccaccagccgtacgtcccggcggttggcaaatagcaggagcggcgaggctgtggggcagaagcaaaccgtgagggccactggctaagccagcaagatacacagccctgggatggagcactatgcccagagcactcctggtactgccctgcccatgcccaagacctccagttccttcctcccacccctaaggcgttgtcaggaagttgcctgggcagccccggcccgcatcattcagaggctcctgcagcgcagcaaacagccttcttcccacattcggtgacagcacctgtttgtttaccaactgttacgtctgttcccccagatatgggtgacccttcctgccatgcccaaaacctcccacatcgtcctccagaggctacaggggccctgtcctgttctgcagagaagccacatcccctttgttggcctgacacaggggatggggacatgcaggcacagcactggccatgctgctcgctacagacccagccacagggccacattttttgaggggttcagagcccaggccagacagagcctcaagattcccttacaagtctttgaccactgtccaagctcaggcccgtttccttggccgtggcatcagcttcccatccacccctgtattccatgtttctcccaccctgcttctggacattcctacatttaaagggtcactctggaatgccaccccttggctcagacaccttccacagctccctgtgccagtgccatgcagaacaaggtcagaccccctagcctggcctccaaggccttggcctctggcctcacctacacttctctccaccaccccaccccaagcattcctgatctgcctgcggccaggctggctccctcacctccctgtgcaccgcagccctcagccccttctgcctgtgcaagaagcctcatctcacagacaacggtctcattcccacaacgggctcaatgagaaatcaggagaggccttcagaccatcaccccaccagacacctcagacgtcggaccaggagggtccagcaacccccaacacagactcagagggactaagaagccacatgaggagtgaacacaagatgtggacaggaggaggttaagggcctccagggagctccatcagtccgtgttctgctgtcagcagggttaggctgggctggccacaaacacccccaaaaaacatctgaagccttggcttgaaacagctgacattcctcatgaaaactgcagacccctgggtcctcctgcgcagatgggggagcccagccaaccccacactcccaccttcaccaagaaagagaaagccaaaacaaactcaactcagccaatgacaatcacagaactgaatcctgtagttagttcagttggtttcatttcagcaggggaaagatttgcagcctctatgagggtagctgggaacacaaagggccagagcatggcccaggagaccccagcgcagtggggtagatggttccgagcacaggcctccctgccaagacaagcactggctcaaatcctggcccctcccattcccaggagacatgctccacaggatgggaggacacacagaggacctgaggccaggaaaatgacagcggcgcctccgccgccccacccgtgctgtcatcatcttaggtctacagttctttgtggcaacgagggacactgtgaaagtcaaacaacaggaaggcataggccacaaataaagacaaacgggacttcatgggaagctaaagattttgtgcatcaaaagacactatcgagagagtaaaaaggcaacccacagaatgagagaaaatatttccaaatcatagatctactaagagattaatatccatgaaatacagagaactcctaaaactcaacaatgagaaaacaactaagccaactcaaaaatgggcaaacaacttgaacagacatttctccaaagatgacatataaatggccaataaacacatcaaaacaggcttaatatatccctaatcatcagggaaatgcaaatcaaaactacaataagataccatcttgcaccaattaggacggctactatcaaaaaaacaaaatagcaagtgttggtgaggatctggagcaactggaacccttgtgcaccactggcaaaaatgtgaaatggtgcagctactatggaaaacagcatggcagttccccaaaaacttaaacacagaattaccatatgacccagcaatttcgctttgggttatatacccaaaagaactgaaaacagggacacaatcagatatgcatacaccttggatcacagcagcatccttcccaacagctaaaacatggaggcagccaggcatggtggctcacgcctgtaatcccagcactttgggaggctgaggcgggtggatcacctgaggtcaggagttcgagaccagcctggccaacatggtgaaaccccgtctctactaaaatacaaaaattagctgggcgtagtgacgggcacctgtaatcccagctactcacaagtctgaggcaggagaatcacttgaaccctggaagtggacgttgcagtgagccaagattgcgccactgcattccagcctgggtgacacagcgagactctgtctcaaaaaacagcaaaacaaaaacaaaaaaacaaacaaacatggaagcaacccaagcgtccctctactgagggatgaatagcggggcaaaatctgctccatccacacaatggagtactattcagtctcaaaaaggaaaaagattctggtcaggcacggtggctcatgcctgtaatcccagcacttggggaggctgaggcgggtggatcacctgaagtcaggaattcaaggcccgcctggccaagactggcaccnagctacacanaaagtatanggccccggaaa

SEQ ID NO: 9 - DNA, 72049 bp, Homo sapiens
  modified_base (8356)..(8356): a, c, g, t, unknown or other
  modified_base (8385)..(8385): a, c, g, t, unknown or other
  modified_base (38585)..(38585): a, c, g, t, unknown or other
tataccttgcgcggaccttcggctcctgtggtgaagacaatatgaagaaaatagaaattacccataattttgccacacagacttagttgtgtccatgtatcttgtgcaccttttttctgtttacggatcaaaatcgacttttagggtcaggcgcggtggctcacacctgtaatcccaacactttgggaggctggagttggggttggggggtggatcactgaagatcaggagtttgagaccagcctggccaacatggcgaaactccatctctactaaaaataaaagattagccaggcgtggtggtgggtgcctctaatcccagctactccggaggctgaggcaggagaatcgcttgaacccaggagacagaggttgcagtgagccaggatcacgccactgcactccagcctggcaacagagcgagactctgtctcaaaaaaaaaaataaaaataaaataaataaatacataaattgacttttaggagattggttcaaacaatgtgtgtaatgttgtgtctgagtgtttttcatttatcgttcatgcaaattccgacatcattcactcttctccagagtgtgctgttttcctgcctgtgtcatcacccgtcaccttgaatgccctcgtttaggtaaaataagtacattttattcaaaaatatttgaggacatttgggttgtctccaggttcttggtcttgagttttgctgttcttgtggagccatggtggtgtctggttgcaggaacctccatgcgttccagctgctgcttctgcctgtgttcttagagaggaaatgctggggtccgcggttcccgggctgctgaccaggaagcctgcggtgctttacggcccttccagaagcgggagatgcccccacttaagtgtcagacaggcctttccacctcactggcagctctgagcggctcccttctatttgcagatgactgagaagttaccaatttccacgtttactgactgctgtttctcctgttaatttgtatttatagtcttcgctaatttattgctagggttttggtgttgtccctattgacttgtatgccttttaattttttaaacaacattaatatacttcatttttttagagcagttttaagtttacaggaaaattaagggacaagtacagagagttccttccacctgctgtcctcctctcctcctccccaccttccctccttcccctattgtaactttctttctgatattataaaagtcactcatggctgggcgtggtggctcacgcctgtaatcccagcacgttgggaggcagaggcaggcagatcacctgaggtcaggagttccagaccagcctggccaacatggtgaaaccccgtctctactaaaaacacaaaaagttagccaggcgtggtggcgggcacctgtaatcccagctactcaggaggctgaggcaggagaatggcgtgaacctgggaggcagaggttacagtgagtcgagatcgcgccactgcactccagcctgggcaataagagtgaagcttcgtctcaaaaacaaagtcacacacgcttcttgtacgagggtcatttggccgaggggccagatggctcaccatctagttgggacaggccatgagctcggaatgctttttacatatttacatggttgagaagaaaatcaggagaataatgttttgggacatgggaaaatgacatggaatttgcattttagtgtccataaatgaagttttgtttgctcccagctgtgttgactgaggcaggctggcttcctacagctgcggcagagctgaggaggcgggaaggagaccgtgcaggccgcagcaccgaaaatatttgctctctggcccttcccagagtgcttgccgacctctgtccgacagctagaaggaaggataggacccgtccgacgataaccactgttgacatttgagcgcgtttccttcccggcttttgtgtgagagtggcagtctgtttgcttttgtggtcgggatctgctgcacgcacggcgggctgtttgcatgaggcttcctggaggatagggctgggctcggagctgcacgcagtggggcgtgtcctgcatgcagtggggcctcagaagagagctgtggtgggcggggcagtgccaacgctggtgggtgccaggcctccacgctcagatcagccccggcgacaggtttgggccaccctctctctggcctctgtgcagtggcccaggccgtctgctctgcctggcacacttgcctctgtccttccactgaagcgctcctcttaccctctgctcccggctgggtacgttgaattgtgtccctcaaggagatatgctaaaggtctaaccccaggaacctgtgtatgtgatctaatttggaaacagggtcttggctgatgtaatcaagcgaggatgaggtcaccctagagtagggggcctatatccacggtgctggtgtcctcatgagagcaggtgagcagacactgacactcaggggtgaaggctgcatggagtcagaacagggcttagtgcgatggcggccacaagccaaggaactccaagtatttcctgcaacaccagaagctggaagatgccaggaaggatcctgccctggagccttcggagggagtctgtccctgcagacgtcttgacttttgattgcagggatgcatgtcttagggtgtgtgggggggtgcatttctgatgttagaagccacctggttggtggcgatgtgtcacgggagccctctgcaggttctgcgtgtccatgtggtcggggacagaggtgggcagggacggacggtgtcgagctggacatgtccatgacgtcggccatcccttgggatggcttttttgttttgaggataaggctgcctgccaggaagctgtgccctgcctggcccttgccccaagcccctggcctgtgcttggcctcgcggaagggatgtcgcccttctctcctgcatgcgtgcagggaggaaggggagaggtcagcagcccgcctggaggaggctcgggcgaggggaaggtttcactttcaggcaatgttgtggggctgtttaaacaaccccaaagaaaaccatttggccaaactgttagtttccaaacattttacttccttggtgtttaaataaattcctaccaagactctgtagctggtcccagggaaggagttggcctctcttctttatagcccggcacagtcagtcccctgcacctgcccctcccaaccccaggcctgcttccccgtggccatggctgctgcccggacctctctacacacagaacctcctggaggccagctgtgggcaccagccttggcagggctgtggcggagcccaggctgctggtactctctctgcagctgctccctgctggcctggctggacagcgtccccaccaccactggggtcacctctgtgctggtcacagctcactcagaccttcaggcaaatgggttggatcctgcctctctcccaggtgtctcagtctctgcaaaactcaaaaacctcagaggccttgcagcctgaggggtgtcagagacacctccttcgaatcagtaaacacctacagattcaccccagcagtgaaaggactgcttcgccacagaggtttgatttactcctaagtaattggaagggatgccgagaataggttcctcatggtgggactagaggccctctgctgacctagttaacagagggctagggctgggtgtgctcagcccctgaaggttctaggcccatttgggacaccccgccagaacctgccacaacctgccatgtggtgacagctacctaaatcccagaggctcttgagctggagagcagacctctcaatctcagcaggccccccacacagaccccataaccctagtctgccttcacagtacagttcgtggctatgtgttcacggatggtgttgttcacctaaggtctctgccctgtgaccccaagggcgtcctgagggcagattccaagtctgtttcgtccacccctccttccctagcagcgggtccagggcctggcctgaactagcttcccacagagatactggtgggatgatgaaggcagccaggcggcaagtgaaaaacgcacttcctgcatgtgctggctcctgggattgaagtgtttgaggaagcaaagtgaagtgagctttcctcttgcggctgtgtgtccttgggccgggagcctaccctctctgagcgttggggtccttgtcagtagaatggggcatcctcatagctcaaggggtggtgtgtgaaaattgtgctattgtgttactttaatgattttttttttttcgagacaaagtctcaccccaacgcgcaggctggagtgcagtggcgcgatctcagctcattgcaacctctgcctcctgggttcaagtgattctcctgcctcagcctcccaagtagctggaattacaggagtgcgccaccaggcccggcatatttttctatttttagtagagagggggttttaccatgttggctaggctggtcttgaactcctgacctcaggtgatccacctgcctcggcctcccaaagtgctgggattacaagcatgagccaccgcgcccggcctactttagtgatttcttaggaggacagagggaacgggctggcaagacaggcttggaatgtgttttgggatcaagtgccggtttctgtctggcactggcgttctctgtggggccatgatggacacactgctgaggtcaagcgtgattcgtcttgcgctgtgcctggcagtctcattggaaagttctgtagacatcgtgtggatggggctcttcccggccaagcccttggggaccttccaggactgtgatctccccacagtggctgttaagcagggacctttcgtgaagtggagtctctggtcccctccaagtcatagctagacagggactcgggcatcgccaagcctggctgattattcactggatgaggagacaggcccagagaggggcaggaacctgcccgaggtcacccagcaggccccagaggtttcggtctcggattctccctgctcatccctggatgtagtgctgctgtggatgtggttctgtgctgggggctgtggagagcagggggcttgtgccaggaccccagtgagggtggcgccctcgccatgaggccgactgttggtatggggcggccatccactggggtgtggggaggaacagctttcctgaggaggaggtggcgggaggaacagcttccctgaggaggaggtggcggtgctgtgtgacctgggccttgaaggacaggtccattgtcaacagaacattttgggagtggagcctagagggagaaaatttgttgaaattcagattcccctccccctaccaatacacaccaaatcagatgcccctgaccagatctaaatttggctctcagagatttccattgtagctgggcacttggggaaccttctaagtgctgcctctgcctctccccagcctgcctgcctcagtttccccagccctgggcccgtgtcgctgttgccatcacgtgggcgccctctagtggaggaatcagattatgcactccggggcttggagcaggagtcaggaggggctcctgtctttccttgaaacgttggatgccgggatcctggaacagtctctgcattcctcctggcgagaaccagagcctgggcacaggggaccatctgttgtttgaaggctgcagcctggcagggcactcaggagatctggcagttggctgcagggccaggtctaggggccagggcatcagggaggctctgggctggttcagccccgggcccctttgcagattgtgacctgggcccctgtgcaggggcatggccacaggatgctgggaggggtctctgaccctgaccttcttggctctgtgcatccttgagaccagaaaggtctggaacaaatgagtagacgatgccctaacctggggagggagccacatcctgatcccagcaacctcgggaaggatctgtcaggattatggggcaccctgggggccccaagtctgcatgggtctccacttgcaatttctgtaggaagctctgataaatccaaactgggggtcctaggacacagtcagaaatgctgataccgttgtgtgtggagcctcgggccctgggggtcaggagcatgtggagggtgggccacgggggttcagaagagaatcctgtaaccccccaccccccaaactgaagcccacttgagggccatggctgaaaggttggggggtctccgtgcgtcctgtggagtgggtggtgaggagtccttgggtttgcacgcctctgggcctgagcggcgggaccccgtccacagcggatccctgggccctgttgctcagatgctctcagagtgttgctgtggccacggagggagcctgagttaagcttctcttgtgccggttgtacgctgtcaggtcacactggtgagttaggcagggcacagatgcccagagcagagggaactttccttggggattcaacacgtgcaagtcttaggggctggcaaatcctgccctcagctagagagggggcttttatttgagaccagaatcacctgagcatcctcctgtccccagctgtgtccagcctgtctgcagggacatcctgagaggaccaggctctcccctcatccacctgcctaagtgccactctgaaccctgtccacctgtgccgtggaggggcgtgacctcaagctgctcagccagcagcaggcttggccctggggggcagcagagacccaggtggctgtggggtgggtgcttcgtggcgtggttctgaaacttcgttggaagtgtgtggacagtgccttgcctgttctctgtgggaccctatttagaaacgaggtctgagttactgggggtcatcactgtgttctgatggcccagctgtgtggaggccgcggtgcagccccatccaaggagccagggccctgggtctagccgtgaccagaatgcatgccccggaggtgtttctcatctcgcacctgtgttgcctggtgtgtcaagtggtcgtgaaactctgtgttagctcttggtgttcctgaaagtgcccccgggtctcaggcctcagaaccagggtttcccttcatctcggtggcctgggagcatctgggcagttgagcaaagagggcgattcacttgaaggatgtgtctggccctgcctaggagccccccggcacggtgctggggcctgaagctgccctcgggtggtggagaggagggagcgatgaagtggcgtcgagctgggcaggaagggtgagcccctgcaaggtgggcatgctggggacgctgagcagcatggccagcagctgggtctgcagcctggtacccggcgggacttgtggttggggctggtttgtggccaggagaggggctggcaggagacaagggggactgtgaggcagctcccacccagcagctgaagcccaatggcctggctgtgtggctctcagctgcgtgcataacctctcagtgcttcagttctctcatttgtaaaatgaggaaacaaacagtgccagcctcccagaggtgtcatgaggatgaacgagtgaccatgtagcatgggctgggtgcgtgtcacctaacatcaccagcctttgcaaggagagccctgggggcctggctgagtatttcccttgcccggcccaccccaggcctagacttgtgcctgctgcaggcccttgacccctgaccccattgcacctgtctccacaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatggggtaagacgggcgggggctggggcctggagccagggccaggccaagcacaggcgagagggagattgacctggacctgtcattctgggacactgtcttgcatcagaacccggaggagggcttgttaaaacaccggcagctgggccccacccccagagcggtgattcaggagctccagggcggggctgaagacttgggtttctaacaagcaccccagtggtccggtgctgctgctgggtccatgcgtagaaagccctgnaaactggagggagccctttgtccccctgncttcagtttcctcatctgtagaatggaacggtccatctgggtgatttccaggatgacagtagtgacagtaagggcagcctctgtgacactgaccacagtacaggccaggcctctttttttctttttttttttgagatggagtctcactctgtcgcccaggctggagtgcagtggtgtgatctcagctcactacaacctctgcctcctgggctcaagtgattctcctgcctcagcctcctgagtagctgggattacaggtgcctgccactgtgcttggctaatgtttgtatttttggtagagatggggtttcaccgtcttggccaggctggtcgcaaactcctgacctcaggtgatccacctgcctcagcctcccaaagtgctgggattacaggcatgagccaccacgcccggtcaggccaggcctcttttgaacactttgcacaccatgggtcttttcatccaggggggtaggtacagttgtacagttgaggacactgaagcccagagaggctcagggacttgcccagggtcacacagcaggatgtggcaggtgtggggctgggcctggcagcgtggctccagctttccagcatagaaatctgtgaaagcagatagtttgtcggtcggtaggggagactttctgagacccgccccagcggctcagagggtagtagccaggggccttcctgggggctcataacccagaacactgaatgggaaaaccctgatggaggaggcgcagtggagctgtgggtgccgatgggaagtcccagaggagctgggaggtcagtagcggtgctgccctctgtggagcacttagtgggcaccaggtgtgtttccaggttcatggccctgggacctgaagctcagaaggtgaagtaacttgcccagggcacccgtcgggcagcggcgggcagaggatttgtgggctgtggagcctgtgctcgtggcccagccctgggggttgtgagtgtgctggccggggagcttttcctgcaagtggactggtgtctaggagccagcatgtcaggcagcaggcagcgggagtgcagcaggcagcgggagcacagcaggcagagggcggggctcgagcagccatccgtggaccctggggcacggaggcatgtgggagagggctgctccatggcagtggctgaagggctgggttgtgccccgaggagggtggatgagggtaagaagtggggtccccaggggctttagcaagaggaggcccaggaactggttgccagctacagtgaagggaacacggccctgaggtcaggagcttggtcaagtcactgtctacatgggcctcggtgtcctcatctgtgaaaaaggaagggatggggaagctgactccaaggcccctcctagccctggtttcatgagtctgaggatcccagggacatgggcttggcagtctgacctgtgaggtcgtggggtccagggaggggcaccgagctggaagcgggaggcagaggggctggccggctgggtcagacacagctgaagcagaggctgtgacttggggcctcagaaccttcacccctgagctgccaccccaggatctgggttccctccttggggggccccagggaacaagtcacctgtcctttgcataggggagcccttcagctatgtgcagaaggttctgctctgccccttcctccctctaggtgctcagctcctccagcccactagtcagatgtgaggctgccccagaccctgggcagggtcatttctgtccactgacctttgggatgggagatgagctcttggcccctgagagtccaagggctggtgtggtgaaacccgcacagggtggaagtgggcatccctgtcccaggggagcccccagggactctggtcactgggcttgccgctggcatgctcagtcctccagcacttactgacaccagcatctactgacaccaacatttacaaacaccgacattgaccgacaccgacatttaccgacactgacatttaccaacactgtttaccaacactgacatctactgacactggcatctaccaacactgacatttaccgacactgacatttaccaacactatttaccaacactgacatctactgacattggcatctaccaacaccaacatttaccgacaccaacatttaccaacactgaaatttaccgacaccgacatttaccgacaccgtttaccaacaccgacgtttaccgacaccgacatttaccgacactgatatttaccaacactgacatctactgacgctggcatctactgacaccgatgccagcatctaccaacaccgacatttaccaacactgacatttaccaacactgacatttaccgacattgacatttactgacactgacatctactgacactggcatctactgacactgacgtttaccgacactagcatctactgacactgacatttaccaacaccagcatctaccaacaccgacatttaccaacactgacatttactgacactgatatctactgacactggcatctactgacaccaacatttaccaacaccagcatctaccaacaccgacatttaccaacaccagcatttaccaacaccgatgtttaccaacgccgacgtttaccgacgccagcatctaccaacactgacatttaccgacaccgacatttaccgacactgacatttactgacactgacatctactgatactggcatctaccgacactgatatttaccaacgccagcatctactgacactgatgtttaccaacaccgacatttacgagcaccgacatttactgacaccaatatttactgacatcaacatttagccatgtgatgggggccggcttgggggcaggccttgctcttggcactggggatgctgcagagaccagacagactcatggggtcatggacttctgcttcttctccagcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgaggctcctgtggacatgtttgatccaggaggccaggcccagccaccccctgcagccagatgtacgtattggcgaggcaccgatgggtgcctgtgctctgctatttggccacatggaatgcttgagaaaatagttacaatactttctgacaaaaacgccttgagagggtagcgctatacaacgtcctgtggttacgtaagatgttatcattcggccaggtgcctgtagacacagctacttggagactgaggtgggaggatcgctggagtccaagagtttgaggccagcccgggcaaaggggacacaggaatcctctgcactgcttttgccacttactgtgagatttaaattatttcacaatacaaaattaagacaaaaagttaatcacatatccactgccctgcttaagacagaaaacatgggtgttgttgaagccagaggcagctgctggcctgagtttggtgattggttcctaagcagttgaaggcagttttgtttttccatagatgtctgttctccctttgctgggtgcagcctcgccctgctgctgtggtcgggtttcagtggcctcgtcccgtggacgcagcctcgccctgccgctgtggtcgggtttcagtggcctcgtcccgtggacgcagcctcgccctgccgctgtggtcgggtttcagtggcctcgtcccgtggacgcagcctcgccctgccgctgtggtcgggtttcagtggcctcgtcccgtggacgcagcctcgccctgccgctgtggtcgggtttcagtggcctcgtcctgtggacgcagcctcgccctgccgctgtggtcgggtttcagtggcctcgtcccatgggcgtgctttggcagctttttgctcacctgtggagcctctcttgagcttttttgtttgttgtttgtttttgtttgattttgtttgattgtttgtttttgttgtcgttgttgttgcccaggctggagtgcagtggcgcgatctcagctcactgaaacctctgcctccttgggttcatgccattctcctgcctcagcctcccacatagctgggattacaagtgcccgccaccacgcctggctaaattttgtatttttagtagacagggggtttcaccatgttggtcaggctggtctggaactcctggtctcacatgatccacctgcctcggcctcccaaagtgttgggattacaggcgtgagccaccgcgcccagccctctgttgagcatattttgaggttctcttggtgccagtgatatgtacatgtgtccccatcgcaccatcgtcacccattgaggtgacattggtgcctctcctcggggtggatgcctccctctgtttccagcaacttctgaaggattttcctgagctgcatcagtccttgttgacgtcaccatcggggtcacctttgctctcctcagggctcccaggggaggcccgaatcaggcagcttgcagggcagggcaggatggagaacacgagtgtgtgtctgtgttgcaggatttcagaccctgcttctgagcgggaggagtttcagcaccttcagggtggggaacccagggatgggggaggctgagtggacgcccttcccacgaaaaccctaggagctgcaggtgtggccatttcctgctggagctccttgtaaatgttttgtttttggcaaggcccatgtttgcgggccgctgaggatgatttgccttcacgcatccccgctacccgtgggagcaggtcagggactcgcgtgtctgtggcacaccaggcctgtgacaggcgttgttccatgtactgtctcagcagtggttttcttgagacagggtctcgctcgctcacccaggcgagagtgcagtggcgcaatcacggctcgctgtagcctcaatctccctgggctcaggtgatcctcctgcctcaccctctgagtagctgggactacagacacataccaccacacccagctagtttttgtgtattttttgtggggggagatggggtttcgctgtggtgcccaagctgatctcaaactcctgaggcacaagcgatccacctgcctcggcctcccaaagtgctgggatgacaggcatcagccgtcacacgcagctcaatgattttattgtggtaaaataaacatagcacaaaattgatgattttaaccattttaaagtgaacagttcaggctgggcgtggtggcttatgcttgtaatcccagtactttgagaggctgaggtgggcagatcacctgaggtcaggagtttgagaccagcctggccaacatgatgaaatccagtctctactaaaaatacaaaaattagccgggcatggtggcaggtgcctgtaatcccagctactcgggaggctgaggcaggagaatcgcttgagcccgggaggtggaggttgcagtgatctgagatcatgccactgcactccaatctgtgtgacagagcaagactctgtcttgaaaaataaataaataaaaaaaattttaaaaagtgaacaattcagggcatttagtatgaggacaatgtggtgcaggtatctctgctactatctacttctagaacactttcttctgccctgaaggaaaccccatgcccaccggcactcacgcccattctcccctctctcccagcctctgtcaaccactaatctactttctgtctctgggggttcacttcttctggacgttttgtgtgactggaatcctgcaatatgtggtccctgcgtgtggcttctttccatagcattgtgttttccagattcacccacacattgtcgcacgttatcagaatctcattcctgactgggtgcagtgggttaggcctgtaatcctaacattctgggaggccaaggcgggacgatcacttgaggcaggagtttgagaccagcctggccagcctagcaagaccccagctaccaaaaaattttaaaagttaactgaacgtggtggtggtgggcacttgtggttcccagctacctgggaggctgaggttggaggatcgcttaagcccaggaggtcaaggctgcagtgagctatgatcgcaccactgcactccagcctggacaacagagcaagaccctgtctgaaaaaaaaaacaaaaaaaaaagttcctttctttttgtggctggatgacatcccattgtatggccacagcacattttgtttgtctgtttatcgggtggtgggcagtggtttccaccttttgtctcctgtgaataatgctgctgtgaacatttgaattcaagtttttgtttgaacacctgttgtgaattatttggatatatgtgtaggggtaggattgctgagtcctatggtaatgttaggtttgacttactgaggaaccattaaactgttttcaacagtggctgcgccgttctgcatccccaccggcagtgtgtgagggttctgactttacctcctcacaaacgcttcttttccatttaaaaaaatattcagccaggtgctctggctcacgcctgtaatcccagcactttgggaggccgtggcgggcggatcacctgaggtcaggagttcgagacgagcctggccaacatggtgtaaccccatctctaccaaaaatataaaaattagccgggtgtggcagcgggcgcctgtaatcccagctacttgggaggctgaggcaggagaatcacttgaacccgggaggcagaggttgcagtgagccaagatcgcgccactacactccagcctgggtgacaagagtgaaactccatctaaaataaaacaaaaataaaaataaataaaaatttattaaaacattcatcacagccagcctagtgggtgtcccatgtggctttgcctcgcatttccctgataactaggatgctgagcgtcttgtcccaggcttgccacacctcagcactttgagatacgtcgcacagtccccatttgcgaacgagaaatgaggtttagggaacagcagctgtgtcatgtcacacagcgagcagggggtctctgagccgtctgaccccacagccgaccaagctccaatccttaccgcctcctagtgttgtggatgtagcccagggtgctcccacatttttcagatgagaacaccgaagctcaaaacaggagcgttttgtccacattggatacacgatgtctgtggtttggtcctgaagtcactttatatctcagtggtccagactggagtaggacagggggttctggggaatggggaaggtgtctcaggtgaaaggaaggaattccagattctccatactgtccttgggaagttagaagactcagagggtctggcaaagtcagacaaagcaagagaaatgcagtcaggaggaagcggagctgtccaggaacaggggggtcgcaggagctcacccccaggaactacacttgctggggccttcgtgtcacaatgacgtgagcactgcgtgttgattacccactttttttttttttttgaggtggagtctcgctctcttgcccagtctggagtgcagtggcacgatctcggctcactgcaagctctgcctcccgggttcatgccattctcctgcctcagcctcccgcgtagctgggactacaggcgcctgccaccgcgcccggctaatttttgtatttttagtagagatgggatttcactacattagccaggatggtctcgatctcctgacctcatgatccgcccgtctcggcctcccaaagtgctgggattacaggcgtgagccaccgcgcccggcccgatttcccactttaagaatctgtctgtacatcctcaaagccctatacacagtgctgggttgctatagggaatatgaggcttacaggccatggtgctggacacacagaagggacggaggtcaggaggtagaagggcggagagagggaacaggcggaggtcacatccttggctttcaaaatgggccagggagagacaccctctgagcatggtaggacaggaaagcaagattggaacacattgagagcaaccgaggtggctgggcgtggtggcttacgcctgtaatcccaacactttggaaagctgaggtgggtggattgcttgaggccaggagttcaagaccagcctggccaacatggtgagaccccgtctctactaaatatacaaaaattagccaggcgtgatggtgcatacctgtaatcccagctgcttgggaggctgaggcaggagaattgcttaaacctgggaggcggaggttgcagtgagccgagatcccgccactgcactccagcctgggccacagagtgagactccatctcaaaaaaaaaaaaaaaaaagataaaaagaccaaccgaggaattgaagtgggggggcgtcacagtagcagaagggggatcgtggagcaggccaccctgtggtcatgcactggaagctcattacctgacgatttggagctcatcactgggggcctaaggagaatagatactgaaggatgaggagtgatggcgcggggcacgggtgtctttggtggccagaacttggggactgctggggtgcctcactgcaggccttctcagcgccctttatatgcttacacaggctgtttctaagagggggatacattgcataagcgttttcagactacctcatcatgggtccctttctttaccctctgtggccctggtggcgcactctctgggaaggtgcaggtggatgcccagacccgccctgccatccacctgcacgtccagagctgacttagcctcgagattgctgctggcacctcctgccccgggacacctcggatgtgcccgtggagatgctggctctgtgttttctgctggagtttggtgcgtcttttcctcctgcaagtggccaccgctcttgggtatgtcctcaggcttctgcgagtcatggctgcttctcaggtccttgcccagcgccaggagcaaaccctcctggcactttgttcaggggtggatgcgccagtgttcctgctgtggaccgccatctcacatgagggtcttgggcctgcaggctcgttcaggaaacacccgctgagtatgcagtgtgtgccagctgtgtcccaggcaatggcggggacagtggctgctgctggggttgtggtggcttctggggactctggggacagctgaggtgcaaggagccacggctccttgaggatgcagttggactccaggtggaagggatggttgggggaggtataaatggggtcagggaggagacacatttggaacaatgggaacatttttaagatgctatgtcgggaggcaacaaggtggccaacccaggtgctgaggagcccacaccagccctggacgtgttttgccgctcacctttgctggggagtggtgggagagaggattccgttccacgtggtggtgtgcgcagctgggctgtgtggagctgggcgctaggaggaaggtgctttctgcggggctagccgggctctgcctttgaacacaatcaggctccaggttttcagcatccagtgcatgagaggacttcacgggcagctgtggctgatcccttgatgaattgggagaagaacaaaggtctatgaaatgaggtttcatgtagatggcattagagacgcccacaacagatttacagagtggagcggagacggcggatgggtctgggaggcccctcctgctggccttgactgtgacagctgtcctgggaatcagcttccaggccgccccagcagcctgactgacacacacaggggttttagccccatcctgcgaccagctgttgccatcatcagtgacagctgggagtggcggtggttccagccctgggcaccctccccacctgctggggcccacccagggcagtcctgacacctacaggttgcttggagccgcatccgagtcctgccccaccacgtgtgaagcccgagtggtcgtgggctgaggtcccctgattgcatccccacttcccttctgcttcacatagctgcctcttctcaccgtttttccagcctcctgggctaggaattccagtgttgtgctggctttgccccaggacacctccttagccctcttcctgagtctagagccccgggggttggaagtcctggcccctgggacacctgcagccacactcagcttctcctgtgagcctccagcatgtcccctcaggaccaagccctcacgttcttgcctccccgcccacctgggctcagccaggggaaggcctggctgggagcgtctcccctctgccctgcccttctcccctcctaccctgcccttctctcctctgccccgccatggcttttatatcctgtgccacaagacatggctgtgtgtgaaagtggcagggtctggcatctctgtgggtctctgaggcccacgctccagtgccactcttcccacccgctggccgtgccctcatgctggagggacagcccagccctctcccgaaccccagccccatgtgcccagctgcccccggccctctcccctggaagccggggtcactccagccgtatgccatggtggggacatcctgcttccttggccttccagggaaggtcctctttccaaatggcgacacctggtccctgcctggaggctggaagctgtggcccttgtatgcccctccagggtctgtgcgctcggttggcccgagttcccatcaccgtcatcatcaccatcatcattgtcatttcgcttgtctgtgagccggcctggtctcccagagcagagaccctctgaggtccagcctgagttggggtctccgtgctgacccctgacggggactcaggacgtaccaggtctgggtcaggagtgacccccaaacctcgtgccctttgacaggcacccctgacttttgctaagtgggtggaggtgacatcacttacagcgggagtgatgggacagggtctgttggctgcactgtgctcccagggatctggggagaggctatatccctgggctttggcactgcagagctgtgtgtgtttgtgtgtgtgtgtgtgtgtgtgtgtgtgtgtgtgtgtgtgtgtgtgtttgcgtgcgcgcacatgtgtataagatctttttttattacatgaagcaagataactgttgctgtttccttttgggttttgtgttcaacagagtggggtacttcttccctcagacaacagaactctcccctttaaacacgtgctgtcagagggtgggtcttgggctcatgtctgtttgcacagccgagtcagaggaaacacagggttcttcataaaaacactgcacagcaggcgactgtccagagtcagcctgcaggacggcagcagccctgcccctcagagcacagctagggtgggctgctttgggatctcccgtcattccctcccagctggcagccggcggccggcccattccttggtgtgctggtcaggggggcgtgcgcctgctctgctcaccctgggaatgggacagaagctggcagctcggagaggacagggctggacccttgggtggcctctggctggaccatctcattgtcctcagacacagcctctcgggtctagtttcatttcctgaaaaacaagtgcacagaactagagcaggagtcgagagctacggcccccgggccagatccagccctgccacctgttttcacaccatgctcaagctgagtgggttttacattttttaattacttgaaaaaaaaaaagccaaaggaggtttcatgacccatgaaaattatatggaattcaaaaaaaaaaaattatatggaattcaaatttcagtgtccataaataatttcttgagacagggtctcgctctgtcacccaggctggagtgcagtgctatggcatggctcgctgtacccttgacctcccaggctcaagcgatcctcctgtctcagcctcctgagtagctgggactacgggtgtgtgccaccaagcccggctaatttttttttaattttagtaaagacagggtctttctatgttgcccaggcttttctggaactccatcttggcctcccaaagtgctgggattacaggctcgagccacggagcccagcctgtttttgttttttcactgataaagttttgccgggtgtggtagtgtgtgcctctagcgatttgggaggctgaggtgggaggatcgcttaagcccaggagtttgaggctgggctcaagtgatcaggaggtgaactatgatcatgtcattgcattccagcctgggtgacagagcaagaacctatctcttaaaaatatatatttaaaaagtattgggtgtggtggctcacgcctgtggtcccagctacttaggcatctgaggtgggaggatggcttgagcccaggagtttgaggttgcagcgagccaagatcgtgtcactacactctagcctgggtgacagagcccagaccctgcctctttaaaaaaaaaaaccaaaaaacatgtattggaacacagccatgcctgttcagtcacgtgctctccatgctgctttctgctccagagacccttatggcctgaaagctgaaaatattttctatcctttacaaaaaagtttgctgacctctgtcctggaaaattcatctcccaagttctcttccggcactggcgttcctgggtgtcctaaatttggcccctgttatttctgaactctgttttggctctgttccctcccaggagccaggacaggcacgttctctgcatcttgtcccctgacgcccagaggcttggctcggctcaggcattcttggaaatatctggctccaggaaaggcagaggcctcctgagtcggcccagagggaacctgccccaggtctgggggaggcctgacccagcagagtggcttttgccgatgggttgggccggtcaagatgtgctgaaagttgtcctcagaaggccactttgggattccttcctccagtattagagcaactgagagctgctcattgcaagcctgatgttttcccagttggccgggtccaccgggtgccctgggattctgggatctgggtggaaagtagggggcttgggggagtgtcctgggttctggaatccaggtggcaagtggtgaggttcagggagtggcttctgagccaccataggggtctctgtgggaggctctgcccatccaggagattccgcaggccctgccggcccagagccagcgtcttgcgcttgccgaggctacagccagccccagccgggtggaacagcccgtcgcctcctctcactttgttttggggccacctgggagtgtggagcaagggtagagagggaggaagtggctgccggccgctgcccagcacccttgtttgccttgggccctctgtgggctcctttttattgctcttcaatgaagccagggaaatggacttccttgcctcacttcagttcaacatgtctggaagtttggtattaaaattaagaaagtgtggaaatagagcaagaagagaaaaatctctccaagagataatagtgacctctgagctgggcgcggtggctcacgcctgtaaatcccagtactttgggaggctgaggcgggcagatcacctgaggtcgggagtttgtgaccggcctgaccaagatggagaaaccccgtctctactaaaaataaataaataaataaataaataaatacaaaattagccaggcatggtggcgcctgcctataatcccagctaaggcaggagaatcgcttgaacctgggaggcaaaggttgcagtgagccaagatcacgccattgcactctagtctgggcaacaagagtgaaactccgtctcaaaaaaaataaataaataaaaaataaaaatagtgacctctggccaggtgtggcagctcatacccgtaatcccagcactttggaaggaaggccgagatgggcagattgctttagcacaggagtttgagaccagcctggccaacatggtggaaccccatctctacaaaaatagaataaaatttaagaggtaatagtgaccttttggtagatcgaaacctggattgctttctttttctaaatgctgattcttttctttgtggtgtttgtgttctgtgccgatgtccctcccccagccctgttattgtgagtggaagaaggggaaagggttcgcccgctactgtgagcccctcctctcacgctgggtgtccttggagaagcctgcacttcttcattgtacgccagggctgggtccctccctggagtggttctgtgctgctgggatggggccaacccctcagatgttttctgagtgtcacacacaggtgtgtgcattcatggcctttgcgtgtcttcctgttgtggaggcaaaaatgtgaagaaccctagatgattttgggaccagggctccatcacctgctgttcattgcacaccggagcatccaggcatgggtggagagctcagacttccaggcacggtcgcaggggctggtctaaccatgttcccgcccgcctgctcgtcagaaccgcctgttgggagctgttatcatgataccatacctgggccctgggctatccgattctgacttaattgctccaggttggggccaggccgttgtttgctgttttgttgtttcttctgtgacgttagccactgggctaatctgagcccctcagttacaggtggagaaactgagacccatgggggtgcaaggacttgccgaggacccagagccccttgggggcagagctgaggcggggcctggctttgggtcccagagcttccagtccccttcccgctctcctaacagcttttttttttgagacaagatctcaccctgtcacccaggctggagtgcaatggcatgatctcggctcactgcaatcttcgctagctgcgttccagcgattctcctgcctcagcctcccgagcagctgggattacaggtgtgtgccgccatgcccagctcgtttttttttgtacttttagtagagatagggtttcaccatgttggccaggctgatctcgaactcctgacctcaaatgatccgcctgcctcggcctcccaaagtgctaggattacaggctgggatcacactgtgcctggccctagcagctttgtcctgtgccatccaacaacagatgaccgaagtctttgtttcttaacatgcattccatctgccttacagttttgccacctgcaaaacagaggacttgtcgcttttctggtaagctggaaatgtaatctggtagcaggaggcctgtggaagcttgcctttaatggccttgtgtctctttcatcctgtcctgagagccggagaacttggatgttgcacctaactcaaccttcctgttaacatacagttctgcaggctcatggatcatcagaaccacgtcctatctcacgcggctgtatgcttccgttggttcaggtgtttttaccttgacagtattttctcctcggtggcttttgcggtggttgcttttaatcagcattgactcttcaagaaaaatatttagctgctacatctcagaggagacagggtggaaagcatctgagacctgcaggctcagacttagaaccagaagtgccctcagagttcatccggccctgacccagcgggaaatgagttcacagagaagcgggagaactttgccccaggccctgccgttgctcataactgccccaggtccttacatttgctccaggtcctgccccaggccctgcagttgctcataactgccccaggtccttatatttgctccaggtcctgccccaggtcctgcagttgctctgtgtggtgggtgtgatctggagccctccgcccattgctgcacctggggcaggcattgctaattgatcccaggactccttcctgcggagcacgccctggttctccaggcagccgctgcctgtcagcctgcagtggttcgggagaggacacctgcttgcctggtctgttccaaatcttgcttctcatcccagcacaggtagggggtgctatgggaaagggatcctcagttggccctgtcactgctctatcagctggggacgtggcatcctagtgaaaacatcatggccgggcgcggtggctcacgcctggaatcccagcactttgggaggctgaggagggtggatcacttgaggtcagaagttcgagaccagcctggtcaacatggtgaaacccatctctactaaaaatacaaaaattcgccaggtgtggtggcgggtacctgtaatccgagctactcgggaggctgaggcaggagaatcgcttgaacctgggaggtggagcttgcagtgagccgagatcttgccactgcactccagcctgggcaacagagtgagacgctgtctcaaaatctcaaacaaacaaacaaacaaaaaacaaacaaacaaagcgtcatttatccagcacccctggggaaccatgctacctggtgttttatggtacctggcaaggtgcaggtgaagttgctgctcttgggcattgaacccgtcttgtttggggcagctcaggccccaggcagggtccgggttggctctcgttggtgtggccctggcccatccagacctatatttctgccgtcctgcaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggtgagtccggggggtcccaagccatggctcagccatgcagacttgcatgaggaggaagtgacgggtccatgcctgggcataagtgttgagctcaggtgccccgacctggggaagggcaggacaggaaaggtgacagtatctggccaaggacagatgggaagggaccaagggagctgattagggagtggttatggactaggaatgtcggtaacaatggttagaaagtgactaacatttgttgagcacctgctgtgtgcccggccctggccgggagccttcgtgcccacagtgaccccgtctgcaaatgtagttccttgccctactcgcactggggagcaggacgcagagccgtgcaactcacaggtgccaagctcaggactccctcctgggtctgcctgggctgggctgtgcttgttgcccctgtggcccacgcatgtgcaccttccacctgaaagccaggatcttcaggacgctccccgaggaggtcgttgtctggcacaatgatttgtctcttcctgaaaaggtgacagagttacactggagagagcagcatccaggtgcggcagggacaggcctggggctcgcgggcagggactctgtgtcctgccggggtcccacactgcacctgcttgtcagaggcactcagtcaatctttgctgatgaaggatgagaggacagaggacgtgatgcttgctgctgcattgcctgcagtcctgggtgagatgcccgggttgactctgctgcccgtcgggtggatgtgatgtcagatccccggctttaaaatacgagggagctgggaattgagggagcaggttggggcagaaagcacagccccgtggaagcctggagctgaggcagtgtgggcgacccctggagcagtgagtgcttccttcatggccttcatcgcaccctgcagtcctcatgtaggggatgccatccatgaatttagttttcccagcctcctttaaaaacgcgttcatgctggggccggggcagtgcagtggctcacatctgaaatcccaccactttgggaggccgaggcgggtggatcatgaggtcaggagatcgagaccatcctggctaacaaggtgaaaccccgtctctactaaaaatacaaaaaattagccgggtgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaagtacaaaaaaaaaaaaattagtctgggtgtggtatcacgcgcctataatctcactactcgagaggctgaggcggagaattgcttgaacccaggaggtagaggttgtagtgagcccgtatcgtaccactgccctccacctgggcaatagagcgagactctgtctcaaaaagaaaaaaaaaaaaagaacatttatgccaggtgtggtggctcatgcctgaaatcccagaactttggaagactgaggcaggaggatcacttgagcccagaaatttgagagtgtcttccctgggcaacatagagagacctcatctctaccagaaaaaaaaaaattagcccggcatggtggcatatccctgtggtcccagctacttagggggctgacgtggcaggatcacctgagtctggaggcagaggttgaagtgagctgagatcatgccactgcactccagcctgggtgacagacagagaccctgtctcaaaaaaaaaaaaaaaaaaaagcatttactatccaccatggaaggtgagactgacctgtgagtgattgttcaaagaacaaaaaataaaccccagagataagacaaaagggtgcctccatgggggtgtgatttaaagctgagaaattgggcttcttccccctcccctctcaccccgtggtttgctaaaggagatgggaaaaaggattctttttttggctgaaatatttaacactaaattaaagccaattttaacagcactttggttgatgagtgaaattaacagactggccaaaaataaacgaacggtctgtactatgtgaaaaagaggcagctttggccatgctgggccaatgtgagttttcagggttgctgggaatgtctgtgaatcggaggaagggcctagctgggactctcaggagccaaggccctgaggggcaacttgcctggtccctgccctgaggcgttcactgctttcttcctgggccagatcacaggcccggaggctggaccactgggctggcactcttgccgagctgctccctgacttcctgaccatgctcctttcagcagccttgctgcactttagtttccttgaatgaaaaatggggatgagaatagctcctacctccaaggtgaatggagtgagttcggacaggtgactccctgggaccagtgcctggcgcctgacaaggtccagtcagagcccgcactgctgttactgatacccttggctgtaccaggggagaacttggttgccattgccaggtgttctcccaccacccccactactgtccctgtttgatgtgtggcgggaataaagctgtgcacattggagcttttggcacatcctggctttcaggtgaaaggtgcgtgtgtgtttgagggtttagcctggccaacccagccatgaggtcggacctgacctgggggtgagtcctgagctcggcacccctgagctgtgtggctcacggcagcattcattgtgtggcttgggccgcacccctttccctgctgggctgttgatgtttagactggagcctctgtgttcgcttccaggaaccaacccgtgtgcggacaggaacggggggtgcagccacctgtgcttctgcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaaggtagcgtgggccagaacgtgcacacaggcagcctttatgggaaaaccttgcctctgttcctgcctcaaaggcttcagacacttttcttaaagcactatcgtatttattgtaacgcagttcaagctaatcaaatatgagcaagcctatttaaaaaaaaaaaagatgattataatgagcaagtccggtagacacacataagggcttttgtgaaatgcttgtgtgaatgtgaaatatttgttgtccgttgagcttgacttcagacaccccacccactcccttgtcggtgcccgtttgctcagcagactctttcttcatttatagtgcaaatgtaaacatccaggacaaatacaggaagactttttttttttttttttgagacagagtcttactctgttgcccaggctggagtaccgtagcgtgagctcagctcactgcaacctccgcctcccaggttcaagcgattcttctgcctcagcctcctgagtagctgggactacagacatgcaccaccacacccagctaattttttttatatttttagtagagacagggtttcatcatgttggccaggctggtcttgaactcctgacctcaggggaacagacggggttggcctcccaaagggcggaaataacaggggtgagccaccgttcccggcctaggaaaactttttgccttctaaagaagagtttagcaaactagtctgtgggctggccttctgattctgtaaagaaagtttgattggtggctgggtgcggtggctcacacctgtaatcccagcactttgggaggccgaggtgggcagatcacctgaggtcgggagttcgagaccagcctcaccaacgtggagaaaccccgtctctactaaaaatacaaaaaaaaaattaaccgggcatggcggcgcctgcctgtaatcgcagctactcaggaggctgaagcaggagaattgcttgaacctgggaggcggaggttgtggtgagctgagatggcaccattgcactccagcctgggcaacaaaagtgaaactccgtctcagaaaaaaaaaagtttgattggtgtaaccaaagcgcatttgtttatggattgtctgtggcagcttttgttctgccgagatgagttgtgacagatctgtatgggctctaaagcctaaaacatgtgccatccgcccctttacagaaaaagtgtgctgacctctgttctaaagtattggacaactacaatgtttgctcatttattattctatgatttgttttctgctttttgttgttgttgttgttgttgagatagggtttccctctgtcactcaggctggagtgcagtggtgtaatttcagctcactgcagcctcgacctcctgggctctagtgatcctctcatctcagcctccctagtagctgggactacaggcacacaccaccactcctggctgattttttttttttttttttttttttgtggagacagggtttccgcatgttgcccaggctggtttcaaactcctaggctcaaacacccacctcagcctcccaaagtgctgggattacaggcgtgagccaccatgcccagcctattctactgtttgtattacatagctttaaaagattttttatgactttaagtcacaagggttctttgtagaaaaaaatatatatataggaaagtataaaaagaaagtaaaaattgtccataacctctccagccagagacgaccgttgctgacacctcagcatattgcctttaagtcttttttctctaagatagcatttctcttcatcacagtcatatgctacgcagaattctgtatcctgattttttcacttgacattacaacaggtatttgatggcgctgtgacaaactctttggcacaatcttttaaatgtatgaaatactccactgcacagatgtttgcttttaggcttaactgttcttttattttgcgtgtgctggttacagccgggcacagtggctcatgcctgtaatcacaacactttgagagggtgaggcaggaggatcacttgagcccagaagtttgagaccggcctgggcaacatagtgagaccccatctctacaaaaaacttttttaataagtcgggcgtagtggtgcatagctgtagtcccagccaccaaggaggctgagttgggaggattgcttgagccccaggaggttgatgctgcagtgacctgagattactccactgtactccaacctgagcgacagagcaagacttgtctggggaaaaaaaaaaaaaaaatatatatatatatatatatatatatacatatatacatacacgcacacacacataatataaaaatatatatttataaatatataatatataatataaaaatatatatttataaataaaatttataaattatatttataagtaaatatataatatataatataaaaatatatattatataatatataataaaatatataatataaaaatatatatttataaataatatataatacatacttataagtatatatttaaaatatatgtaatgtatattttttaatgtatgatatataatatacatttataaatacacatttatattattttatataaaatatatataaaatctccaagttgctttttccaaaaaggtgtcttgctgcatttcaaacattcatttaaaaacttgaatgctggtgatctggtccagaatgtgttcagtagctgctgccagtggccaagcatctcgggagatgtctacaaaacacgctggttctggcctggcgtggtggctcacgcctgtaatctcagcactttgggaggctgaggcaggtggatcaactgaggtctggatttcgagaccagccttgccagcttggtgaaaccccatctctactaataatacaaaaaaattagccaggcgtggtggcatgtgcctgtaatcccacctacttgggaggctaaggctggagaatcgcttgaacccagggggcagaggttgcagtgagccgagatcgcaccattgcactccaggctgggcaagaagagcgaaactccgtctcaaaaaaaaaaaaaaagatgctggttcctaaaatgtggcccttttcctcctcacctgctgccagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaaggggtaagtgtttgcctgtcccgtgcgtccttgtgttcacctcgtatgagacagtgcgggggtgccaactgggcaaggtggcaggctgtccgtgtggccctcagtgattagagctgtactgatgtcattagccttgatggtggccaggactggtagggccctcagaggtcatggagttccttcgtggagcgggtgctgaggctgtatcaggcacagtgctggctgctttcacctgggccgtctcaccgaagtgtccatggagcctgcgtagggtgggtatctgtgtcgattttacagatgcagaaacaggctcagagaaaccgagtgacttccctaaggtcacatacccagttagagcagagctgggccaggaagtgctgtctcaggctcctgaccaggtctccttgctttgcactcttgccaaaaccatgatccagaactgactttgaggtccccggacctcaggctcctccgaaatggcctcttggaggctgctgagccacagcttaggacccacctcgagaggcaaatgtgctttgagctgccaggcgtcctgggggccctgccttgggcacggggttcagacaggccccagatgtgtggggcgtctttctggacttgagttttcttttctgtgtggtggacacagtgctcaccccttaaagcacctgtgatgtgtgcagcagcccaatccctgcctgtcgcctgttctgctagggaaggaaggaatacttcaggatggcaggacaacagaaagaggtccaggttttagagcaagggcaggtcaaacttagaaaattctggaatgaggatgtgcatttcctcttctggatctgctaaaagaagagggaaggaggggctgctgggggaggagcccagagccgagtttacatccggatcccgcaaggcctcccctgccctgaggtcttgttttgtgatgtgcttgtgtccatcctggtttctgccgtgtccccaacatccggccaagcttaggtggatgttccagcacacactcaccctgtctgtgcacctgtttttgtgtccgtaagtgggtatttactcaccttacgagtgagccactgtgggaattcagggaggtggcgcagtgaccacccctggagggatatgtgtgtggcaggggtcgagggtctcgcccttccctgcttcctgcgcgtggctttctccaggacggggagggctgagctgaagaggtggggacagttgcgtccccccgccacccactgtcctgcggtgagagcagactcactgagcctgcccttctcccttgtgccttccagctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtgagggccgggctggggccttctggtcatggagggcggggcagccgggcgttggccacctcccagcctcgccgcacgtaccctgtggcctgcaagttccccaacctggcaggagctgtggccacacccacgactgcccagcagcctcaccctctgctgtgggagttgtccccgtccacccctgggtgcctttgctgcagttatgtcgggagaggctctggtgacagctgtttcctgtgcacctgctgggcactaggtcccagctaatccctgtgccaggactctaatttcaccctaacacacatggtggttttcattgctggggaagctgaggcctgagcacatgacttgccttaggtcacatagctggtgagttcaggatcccccagagataccagggccagcactcgatccccacccagccctgaaccccaccatgtgctgggattgtgctgggagtgtccacacgcctgggaccccagggctggtgctctcatctcctttttccagatcatgagaatgaggctcagggaagtttgaaaaaaacctatcccaagtcacacagcaacaggagcaggatttgaacccagaaaaggggaccgcacactctgttctgctagagtagttagctgtcctgggtgatatggcaggtgacaggggcaactgtgcttaacaaaggaacccccatcccccctgccaagttgggagactagaaggtcaggggcagaagctctgaagggccaggtgcagtggctgacacctctaatcccagcactttgtgaggccaaggcgggcagatgatttgagcccaggagttcaagatcagcctgggtaatgtagtgagacgccatctctacaaaaaaattttttaaaaattagctgggcatggtggttcatgcctgtagtccaagctacttgggaggctcaggtgggaggattgcttgagcccaggaggttgaggttgtggtgagctgtgatcatgccactgcactccagcctgggcaatagagtgagaccgtctccaaaaaaaaaaaaagaagaagaaaaagaagctctgaggctccaagtccccaggcaccccttggcttgagggcagacaagggaggagagggtcacctgggcagccctgacttttgtcccctggcaaagggaccttcagtgaccttggccctaggagagcctctgagcacgtcagccatgtcgaaccgctcaggaagggcagcaagaatttggcttctgacctctgcctctcctactcgccatctgcactgggtgtggttgtgcccattttacagatgaggaggctggggcatcgaccagctgaatgccttgtcccaggtactgcgtaggcagagctggcagttgaaccccgtgtcctggttgtcgctgggggtgggctgcaccctgacttgtgaggccagtagcaaggtttgcacgtgacttcgtgaccgtcacccagctctgcagcacatcccgtgacccagctcatccaggccgcatgcaaacctgttgccaggcgagaaaccagtcaccgcacagctgtggttgcctgaaatgattaagctcattaatcaccccggagtgaggacagactcagatgaaaaccagcaaaagccctggaaactcatgtgaccctgccaatgagggcggccatgtgcattgcagcctggccgtcactcctcggtacgtgttttggacttaaacgctccggatgtttactgagtgcttgattaataacatggaaggcctggtctcattgctgtgggagtgaaggatgcacagccaggcctgacatgatgagaacaagaacctggagtctcgctgcctgggtggtaatcctggccctgccacttagcaactgtgtgactgtagccaggtcacttaattttgctagatcctgcctgcgcttcagtggatcttgctggttttccaaggtggccaaacactttaaggcattcatgtggtcgctaggctgcagggttgaaccctggctcaccccgcagggcgccgtgtgctctgtggcctggctgtgcctttgctgacaccgtgcccgtgtgtgttcatgcaggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagccgtaagtgcctcatggtcccccgcacctcactccctcgttagatcaggctggttctgggagctgacgctgaaaggagcttctcatctggggttcctgggtgtacatagatggttgggtaggttgtgcactgcacaagctgcatgatgctacctgggggtccaggtccaggctggatggacttgttgcttcatcaggacatagataaatggccaaaactcctcagctggaaggtcctgggcaggatctttgggtgtgaaaaccagtcacaggggaagggtgcttgctcatactgccagcacagtgctgagtgctttccatagcgctcgtttactcctcaagcctggagggtggggagtagcatggtcccatttcacgtacaaggaacccgatgcacagagaggtgtggcaacccatccaaggccatacaactggggtgggttgagccggggttgactgtggcaggctggctcaagagtccctgctcctgaacccttgccaggcagcctggcatcagctcggggaatttttgccctgacccttggaagcaagtgggcctctttgttctcatgtcagtgatgagaagagtgactttcctatggcccctctggagtacaggtgtttcctgttggcgggctcttcccccatgacatcagcagcgagctggttatgattccctacgcagaacttgatagtttataaagctctttgtcatccaggccccgttggagtctcacgcagacctggtcgcaggcggggctggtcttgcctgtcccagctgcatggatggggaacttgaggcttgcaaaggttaaggggctgttcgaggcccacgctggcaggagatgggcctgggccagagtctgggacttcccatgcctgggctgtctttggtcctgttgctcaccatccctccctggggccatgaccttagagagccaaatggaggtgcaggtaacccacggcaaggaggggttgccatgactcagagtccccgtcctgtggccggcagtacctggtgcaacgacttggatttcagaccagccactgtagcccgctgacggtgcgctcgaagtgccacagcttctgaagccaggcaggactcaggccaggagactctgttagctgttgagagggagaggccaacggatgttctggttctgctagagagctggttcttcggatcctggtaccagtgcactgagaggaggcccagcttgattctggggctgccttgtggtggcatgtgctgctcactgacaccctcgaggagtgtcttctctcgggcttgttgactgtgcccggttttccgcagttcactggtgcacacataggcacatagcaaaccgcacacacagtcgtgggtatgagtttcactacattccaccaccagtgttcactaccattacctgccttccgtcttaagtgttcatcatttaaaaataaatttattgggctggacgcggtggctcatgactgttatcccagcactttgggaggctgaggcgggcagatcacctgaggtcaggagttcaagaccagcctggccaatatggtgaaactccatctctactaaaaatacaaaattagctgggcatggtggggcatgcctataatcccagctactcaggaggctgaggcaggagaatggcgtgaacccgagaggcagagcttacagtgagcccagatagcaccactgcagtccagcgtgggcaacagtgcgagactccatctcaaaaaaaaaataaataaataaaagaaaaataaatttatgatctatttcaaaaataacacatgtactttgaaacagcagagacacatatgacacggagaatgaaattccccatagcgcacccccaagagacagccctggtccccccgtctttcccgtggacctccagcggggcagatgctgagccgcctgttgtcgagtggcatgctatcccgtcctccagctcctctgtggcttacagacacccacctgcagccctgtctttgcctcctctagcgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccaggcaggtgccctgtgggaagggtgcggggtgtgcttcccaaggcgctcctcttgctggtttccaggctgctgcccctgtccttagcagagggaggaaacagaggatggctctgggtgaatgatgacttgggcttcgattatgtagtcacagggtatgaccctgagatgcgtggaaccccgagactgtgattatatgtagaaactgggtttccccgttgtttaagtagtcatggtggggtcagaccccacaggacttttgtcttttcaagaaagaaaatggtcgtgtgtcatgcaggggtagttggtactggttaatccaggtttatcctttattttgtgggaactgtacagtcatttctgctacaatgctgtatatgctcttctgaaagacacctatgcaaaatcgcacagtaaaaatgacacaactcatagggaaagcggggccagggcacagccctcaaaatctccatcaatgacatgtaagaaaagagaggaacctgggaaatagcaaagtgccttttgcacattaaatggttagctatatcccacaatactgtgcattcgtaaacgttaatgctgcaataaatacggcacttcaccttgggaagatctggagttggcttatgagtgtggaagggtgtagcgcatgagtttttgtgaaacactggaaggaggattgtgggaaatcaaatggaaagttctcaccccaggcgtggagaagagtgggtcatggccccagcagtgagcccagggaggtcagagacggaggtgtgtgtgtgggtgtgaccctgcgcagttccctgccggctgtagttttttgcattcgcttaatgtttctcgtggaggaaattgtgcatgagcaaatgtgaaaccgtgctgtgctcaaattgtcctaatacatcattgcattggaacagattggctttnttttttttttttttttttttttttttttgaaatggagtctcactctgtcaccagcctggagtgcagtggcatgatcttggctcactgcaacctttgcctcctatgttcaagtgattttcctgcctcagcctcctgagtaactgggattacagggcatgagccaccgcggccggccagatttgcatttttgaaacaactgctaggctgggcgcggtggctcacacctgtaatcccagcactgtgggaggccgaggcaggtggatcacctgaggtcaggggttcgagaccagcctggccaacatggtgaaaccccgtctctactgaatatacaaaaatcagctgggtgtggtggcgggtgcctgtaatcccagctactcaggaggctgaggcaggagaattgcttgaacccaggaggcagaggttgcggtgagccgagatcacaccattgcactccagcctgggcaacaagagcaaaactccatctcaaaaaataaaaaatagaaaaacaagtgctgtagcggaagtgagcactttgcggagtcaggcttgtgtggcctgttccacaaatgatgtgctcacggtggcctcaggcccacctggagtctgcagcatggggcacaacaggttcattagtgtagaattccaggacaggcctggctcctaagcagccttcttttacaaaaactgcagagcccgcctgtatcgtagcactttgggaggccgaagtgggtggatcacgaggtcaggagttcaagaccagcctggccaacatggtgaaaccccatctctactaaatatacgaaaattagctgggtgtggtggcacgcgcctgtagtcccagctactcgggaggctgaggcagaattgcttgaacctgggaggtggaggttgcagggatctgagaccatgtcattgcactccagcctgggcaacagagcgagacgccatctcaaaaaaaaaaaacctacagagccacacggcctctttctccaccgagtgttggtgtgggagcttgtgttattgtggtgaaatcttggtactttcttgaggcagagagaggctgagcgcctggagagactttcacatgggtcgccatgtccgccgtcggtttcgctgttgtgctccccatctgaaggctggtgccgtccagacaggctggacgcccctttccaccagatccttcctcccgcagcagtttctagttacgttgtactgtgaggtctgtgtccttggttgatggcaaaagtcagccgaattgaaattcagagccatgcctggctccctggagcttctctcctgggcagctgtgatcattgcctctgctgtggtgtgggtggtggaaatggattcctttcatcttgcttgctacaggtgactgtcacgtggagtcctttggagagagggacgtgttaattgatggatgtggctcccatgctgagaaagctcctgggcgtacattgccttagagtttcattggagctgcgttcttttatggtgtctgctaggcagaagtgatgaagacttggaagaaaacccagaaggttttccacttaatttggaaaatgtgcttttcccctcctgtgtcttttgctaaggtccagcctcctgcagcctccccgctctgtggactctggctttgattctttattaggagtccccctgctcccccaaaagatggtgtctaaattatcatccaattggccgaggttttgttttctattaattgtttttattttttattgtggtaaatttatataacataaaatttgccattttaattgttttgttattgttgtttttgagacagggtctcaccccagtgcccaggctggagtgcagtggtgcgatcatggctcactgcagcctcagcctccagggctccagtgatcctctcacctcagcctctctagtagccgggactacaggcatacactaccacatctggctgattttttgtattttttttttattgtagagacccgctatgttgcccaggctggtctcaactcctggactcaagccatcctcccacctcaccctcccaaagtgctgggattacaggcatgagccacaacacccagccattttaatttttttttttttttttgagatggagtctcactctatcgcccaggctggagtgcagtggcgtggtatcaactcactgcaacctctgcctcccaggttcaagcgactctcctgcctcagcctcctcccgagtagctgggattacaggtgcccatcactatgcctggctaatttttgtattttttagcagagacggggtttcaccatgttggccaggctggtcttgaactcctaacctggtgatccgcccgcctcggcctcccaaaatgctgagattacaggtgtgagccaccgtgcccggcctttttttgtttttgagacagggtcttgccctgtcacccagactggagtgcaatggtgggctcttggctcactgcagcctccgcctcccaggctcaagttgtgcacctccacacctggctaactgtattttatgtagagacagatttcaccatgttgcccaggctgggcttgaaatggactcaagcagtccacccacctcagcctcccaaagtgctgagattacaggcgcgagccaccgcacccagcccattttacctattctgcagttgacagttcagtggcattcagtcagttcacgaggtaaccatcactgccattcatctccagactacttcaccttctcggcagatgtccgaaactgtccgcattgaacacactcctcatctccctctgacagccaccattctactttgtatctctctctgccttctctaggtacctcatgtaagtggaattataccaatatttgcccttgtgtgactggcttctttcatgtgacatggtgtcctcaaggttcatctgtgttatagcctgtgtcagaatttccttccttaaagcctgaataataacccgttgtaaaggctgggcgcggtggctcacaccctctaatcccagcattttgggagtccgaggtgggcagatcacttgaggtcaggagtttgagaccagcctggccaacatagtgaaaccctggctctactaaaagtacaaaattagctgggtgtggtggcgcgcacctgtaatcccagttactcaggaggctgaggcaggagaatcgcttgtacccgggaggcagaggttgcaatgaaccaagattgtgcctctgcagtccagcctgggtaacagagtgagacttcctgtctcaaaaaaaaaaaaaatcatcggatggatggacggaccacttcttgttatttatccatccacgggtgctaggtttcttccacctttggttgtcgtgaataaggccactatgaacatttccttccgtggtgaaggttttgtactagtgaggaaaaggcgtgtttgtggtgttgcataggattctggtaagaaagtttgcactaaccataagtatttgtactacattaaaatgaaagctcaggggccgggcgcggtggctcacgcctgtaatcccagcactttgggaggccagggcgggcggatcatgaggtcaggagatcaagaccatcctggccaacatggtgaaaccccgtctctactaaaaataccaaaaaactagccaggtgtggtggcgggcacctgtagtcccagctacttgggaggctgaggcaggagaatggcgtgaacccgggaggcggagcttgcggtgagccgagatcgcttcactgcactcgagcctgggcaacagagcaagactccgtctcacgcaaaactctgtctcacgcaagactccgtctcaaaaaaaaaaagagttcagggtttatgaaactggccagccgcgtaaagtttgctgtgttgtttttgtgcccgggaggagtgtggccagggtgtcacgtcacacagtacacgtttctcagatggtggttctccagactgctgtcccaaagtctgtttttgcatctggttcccacagacccaccctccacggtgagcctgattttggccagggtagctggaatcttgcttgtctttcagcccggcagctgtaccagtccagggtccacagctagtggcttttaggaaggaatttgttcagttggctttgacacatggccccctagggtccacagctctgtagtgatgtggatgttgttatctacaaagacacatgatccttcgtgtccagatgaaagtgatgatgtctttgcagctgcccagcaaggctgtgtgtgtgtgtgtgtgtgtgtgtgtgtgtgtgtgtggtgtgtgtgtggtgtgtgtgtgtgtatgggggagggaggcaccctttccatctgggggtgtgtgtgtgtggggtgtgtgtgtgtgtgtgcgcgtgtgtgtggtgtgtggtgtgtgtgtgtgtatgggggaggcaccctttccatctgggtccaagagactgggcctggggaagacgcttctttttatctacttagagactttgttttatttgtatttttttgagacagggtctcactctgtcacccaggctggggtatggtgatatgagcatagctcactgcagcctcggcctcccaggctgaagcgatcctcccacctcagccttctgaatagctgggactgtaggcgtgcgtcaccatactgagctattgttttttttgtttggttggtttaattttttttgatacagatggagtcttgctatgttgcccagactagtctcaaactcctgaactcaagtgattctcccacctcagtttcccgacattctgggatcacaggtgtgagccactgctgtctccctgttttattaactgctgaaagacctagataaagaaagtctgaaaagacttactatcagagcaccatcctaagatgattccctctgactcaatggagagggaggggagcttttccttcaggcctgggtggcaggagcccaggtgctccaggccccatttgccccaggccaaatcactcgggaacttggatgcagctgtctttcagggtaacccaaaggaaccagatccccgcaggcagtaggcttctgggctgtcctctcctcctacgtcagctcagtaagagcccttcgaagggatgctgtgtcggaggccccaaaagcccaggctcatccctgagatgcacagggtgggctgggcttaggcagcgctcgagcatctcctggacggtgaccccagagagtgtggagacggagagtccttgagagtcactgagagacgtggctgccctgccttcccaagaggggctctgagtcattccccacactcacctgcccctacccaccctcacctggcccccagcctcacctacccccacatctgtaccgatccctttacccgcaccttccctacccaccctcacctcccctgtaccttcacctcccccactcacccgcccctgcaccctcacctgtcccccaccttcacctaacccccaccctcacctgccctcccctcacctggcctccttccgttggggaaggggttgtaaggggcggcccccaaactgtctgtcctggtgccctgcagagaaaacagtacgtgagggccgcagtccaaaagcttgagtcctggaaggtggaggagacagggatgtgttgggaagggccccatggtcttggatcccttctcgactgtcaatggggccttcatgggagcgccagtctagtgatgcacagctgggtgcccggcgggtggctgaggaggcctaaagtccgaggcggcaagagctcttccagaggctgttgtcctaatcgctctggcatactcaggcgggcacgtagttaggagctgattggagaggagagacccccacaccaatactgggatttgactttcaggctaaacttgagaagtgtggcctctgctgtcctgccagagctctccagccagtgcccagggctctccagccagtgcccgggggtctccaccagtgcccgggggtctccgccagtgccaggggtctccgccagtgcccaggggtctccgccagtgctcaggagtcttggtttctttgtcttacagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtaggaggccaacgggtgggtgggggtgctgcccgtccaggcgtgcccgccgtgtcttctgccgaatgccagcctctcacaggctggggagactttccaccctggggatccaatgggtggctttccagggtcccaaaagcaaacacaggctctttcacagcccctccaggaaagcagaaagccccaagggctggaagggaagggggagctctgctgagaggttacaaggcagcgctggccgacgggagttgcagttgataggttttgtatcatccttgttaaacttgaaccctgtgcagaaatcccttccacggcatgggggctgcctgttgactcgctcctgttccaccacagggagctcctgggcttcttcctcccagaggcccccgacgctcccacctgttggtcgtcagagcttctggttggtgggaaggcacccaggaccttgaggtctccagagagaaaagccagggaaagagggagaccgaaacccatgtgacatgaaactcaggctccaaactgagcacgggaacgtttggggacaggagcgcgatggccttcctcagatagctggggggctggcatgaagacgggagctacagccagcacaggtcctgggccgggagcccagagattgagccctgactctgtcacttactggccacgtgaccttgggcgggtggcatagcctcttggagactcagtttcctcattggtaggagtgacggccacagtggtgcggcctctgcagcacacggggggctcggtgggcggaagccccgggtctataaggcggctgtgcaggagccagccgagctggtctcccaacagccagggctccggggtccttagcagctgtggggggcctgcacctgtttcccatggctgctgtcagaaattaccagaagccaggtggctgagagtaatggacacttgttctctcacagttcctgagggctgaagcccgagatcgaggtgtgggcagggccctgcgccctctgaaggctctgagggaacctttgggcttctggtggctccaggcaccccttgacttgtggtcctgtcactccagtctctctgtctggctgcacatggcgtggcctcttctgtaccattgaaggacacttcagttggatttagggcctaccctcacccattgtggtcgtatcttgatccttcatgacatttgtaaagaccctgcttccaaataagctcacattctgaggttctggggtgagcgggaatttggagagcattgttcaactagtatagaatgtgacctgtcagcctcgggcagccctgagaggcaggggctttccacagcccagctgggtgccctgggctccgtgctgtccgaggagacgccatccccacacccgtccttcacccgccaccctcccgcaggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggtacgcgccccggggcctgccctaaccgcagacacccggccttcattgtcagtaatggcagcagctgccacattgtccgagacctgccgtgagcccagtgccgcgccaggggctttgtgtgtagcgtgttttgtcctcacactgacagctgtaggctggggttctgagtgagccccacagggcagaggcagaaaatgagtctcagagagggtgagcgagctgcttggggccccacagcaggagatggagcaggactgcagcctagcctctgcccccagcacctgcgcaagaagctgctctgctctggactgtgttaggctgcgagggctggagagaaatgagagttggtgcttagagagggggcgcaggtccccatggcttttcctcttatgatgaggtagatgggtgaagggaggggccatgcttgcaggggccagtgaccgaggcccgccgttggaactgatggccttcatcccgagcccagcccaggtgggagcagggctttccgagggcttgtcttgggtcggcctgcttccagggactctgctgcagctcccacccctgtccaaagcatggaatcccccaggctccctggcagtcctgtcaacctctgtcctcccaagctgagtgtggggcaagttctggaggtcagcactgctcaggggggcccacgggctgcttgcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctgtacgtgggggctggcagtggggtgggcagggtggcctctaaacccgacccctggaggaggctggaggccagtgcaagatcctgtgtggcctcagccaggcggtggtctctgccagatgccaactgttgcccgctggggttcagcgacatgtccgaatgtcccgaggcctctgaggttgttttcttttgccgcagaacaaatcaccacgaacagcgttttaagacaacaccaactcttttttttttttttttttttgagtcaggatcttgctctgttgcccaggctggggtgccctggtgcaaacacagttcactgcagcctcgacctctgggcttaattaagtgaacaccttgcctcagcctcccaggtagctgggactacaggtgggcaccaccacacctggctaatttttttttgtagagacggggtttccccatgttgcccaggctggtctgcaactcctgggcacaagctatctgcctgctgtggcctcccaaagtgctaggattataggtgtgagccactggcctgacaacacccacggattgtctctcagttctgtaaggcaaagtccaggcacagcgtggctcacctgggttctctgctcagggtctcacggggccagaatcaaggtgtcaggaacgctgggccctcagcggaggctctgtggagaaattagcttccttgctcactcagcaggtagcagttgtgggatcgaggttctgttttctctctggttattggtcggggaccactctcagctcctagaggccaccccaggtccttgccccgtggccctctctgcctcagcagtgggggctccctgcgtcagtccctcccgcaccttgagtctctctgatttgcttctaaagggccctgtgattcggctcagccacctttagattaggttagcctcccctttgatagactccaagtcggctgattaataaccttactcacatctgcagaatcccttctgccacataaggtcatgacgccgtgctggggactggggtgggaaattacggggtcatttaggattctgcctgccactgccttgctgtgtcccagggcttgggggaggggcctccacagctgggaccacagtccttcctcccctccatggtaaccatctgaggattacttgagaccagcctgggcaacatggtgagaacccatccctacaaaaaatacaaacaaaaagggaccaggctgggcttggtggctcatgcctataatcccagcactttgggagaccaaggtgggctgatcacttgaggttgggagttcgagaccagcctgcccaacatagtgaaatcccgtctctactaaaaatacaaaaattagctgggtgtggtggcaggcgcctgtattcccagctactggggaggctgaggtgggagaattacttgaacctgggaggcggaagttgcagtgagccaaaattacgccactgcactccagcctaggcaatagagtgagactccgtctcaaaaaaaaaaaagggccaggggtggtagtgacaaagagaccctatcccaaaaaaaccgaacactgaatccttgagactgagtaaggacactgtgaaatttttctgggtggggcagggaacagagcgtcttctgtcatttcttccacctgggtgtggtcagctctccctccaagctgcctcctcttcttctcattgtccgggtgttggacacatttggttaactggatagaataacgcgagttcccagggacttggtccatttgctattttattttattttattttattttattttatttatttatttatttatttatttatttattgagatggagtttcgtttttgtcgcccaggctggagtgcagtggcgcgatctcggttcactgcaacctctgcctcccaggttcaagtgattctcctacctcagccttccaagtaactgggattacaggcacccaccaccataccaggctaatttttttgtatttttagtagagacgggttttcgccattttgcccaggctggtcttcaactcctagcctcaggtgatccacgcacctcggcctcccaaagtgctgggattacaggcatgagccaccacgcctggcaccatttgctattttaattcccatgtgtattagtgtcccacggctgctgtaacaaatgaccacaaactggatggcttaaagcaacagaaatggattcccccaatgtgctggagaccagaagcctgcgaccaaactgttgggagggctgtgcttcctctgggggctccagggaggatctatttgttggcccttccagtgctgtgggtgccagcgttccacacttgtggatgcgccgcctcaacctctgcccatcttcatgtgtccatctcctttgtgtctgcgtctttacctcttcttcttgtctgtgttgcctcttataaggacgtttgtcattgggtttagggcccacccaaatcatccgagatgacctcgtcttgagatccttaacctgcaaagaccctttttccaaaaaaaggttatgctcacagattctaggccttaagacatgggtgtatctttctggggggcactatccaaccccttatacaatgaaagacgggaagagggccaggtgtggtagttcacgcctgtaatctcagcactttaggaagctgaagcgggaggatcacttgagcccaggagtttacaagtagctaggcaacatgatgagaccccatttctacaaaaagtaaaaaaaaaaaaaaaaaaaaaaaagccaggtgtggtggctcacacctgtaatcccagcactttgggaggctgaggcaggcagatcacgaggtcaggagattgagaccatcctggctaacacggtgaaaccccgtctctactaaaaatacaaaaaattatggccgggcgcagtggctcccgcctgtaatcccagcactttgggaggccgaggtgggtgaattacaaggtcaagagatcgagaccatcttggctaacacggtgaaaccccatcaagatcacaaggtcaagagatggagaccatcctggctaacacggtgaaaccccgtctctactaaaaatacaaaaaattagccgggcatggtagcgggcgcctgtagtcccagctgctcgggaggctgaggcaggagaatggcgtgaacccgggaggcggagcttgcggtgagccgagatcgctccatgccattgcactccagcctgggtgacagagtgagactccgtctcaaaaaaaaaaaaaaaaagaaaattagccaggcacagtggcaggtgcctattgtcccagctacttgggaggctaaggcaggagaatggcatgaacccgggaggtggagtttgcagtgagccgagatcatgccactgcgctccagcctgggcgatagagcaagactctgtctcaaaaaaaaaagccaggcatggtggtgcatgcctgtagtcccagctactcaagaggctgaggcaggagggttgttcgacccacggagatcaaggctacagtgagccatgatcgcaccactgccctccagcctgggtgacagagtgtgaccctgtctcaaagtaagtaaataggaggagagacaagtgggcagttcagactgatggtatgggcacagtagagactggtgcagacaggctggcctgtgatgtcaagcaacttctgtaactgtttccggcatccatttgtgtgtcaatttccgtgtcagtaggaagactctgtaggctgccaagaggaataagtgggaggatcctcccagagaggccgggcctgcaggagggccagttctcatgagttcttatttggcccctaccctccaggctgtggttctgaggtgggagacagagcctgacctctgtttgtcttgttttgtctttgcagcagcccacccatgtgcccgtgacaatggtggctgctcccacatctgtattgccaagggtgatgggacaccacggtgctcatgcccagtccacctcgtgctcctgcagaacctgctgacctgtggaggtaggtgtgacctaggtgctcctttggggtgatggacaggtacctgattctctgcctgctaggctgctgcctggcatccttttaaaatcacagtccctgtggcatccagtttccaaagctgattgtgtcttcctttgccctcctttcttttctactatgtgcattcggtgctatgaattttcctctaagtactgcgtttcctgcatctcacaaattttgttacattttcattttcaggtagtttgaatatttttacacttctcctgagatgacatctttggctcatgtgttatttagaagtgttgcttagtttctaaagagttggggcttttccagctgtctctctgcaactgatttctaatttaattctactgtagtctgagagcttattttatatgatttctgttattttaaatgtgttgggtgtggtgtttttgttgttattgtttttgtgtctttttgttttgttttgcttcgtttgttttgtttttgagacagtgtcttgctctgtcactcaggctggagtgcaatggcgcgatctcagctcaccgcaacctctgcctcccgggttcaagtgatcctcttgcctcagcctcctgagtagctgggattacaggtgcacgccaccatacccagctaatttttgtatttttagtagagacggggtttcaccatgttggtcaggctggtctcgaactcctgacctcgtgatccgcccacctcggcctcccaaagtgctgggattataggcgtgagccactgtgcctggccattaggtgtgttttatcacccagcatcatgcagtttatcttggtgaatgttctgtgtactcttgaaaagaatgtggattctgctgttgttgggtggagtgttccagaaacatcaattagatccagttggttaatagtgctcatcaggttgtctctatccttccttcctgactgcctgcttgagctgtcagttattgacaggggtgtggagtctccaactctaatggtggatttgtttatttctcctagtagttctatctttttctctccttctacccttgatcctcttctccccctagggcttcctggtgttggtggtgggagagtggggtagtgaagaacctggactttagggccaaagaggccagggttcaaatcctggctctgtcacttcccagttgagtgaccctggctggtgcctgaatctctgtgagcctccacttcctcctctgtgaaattgagagcacttacctggcaggctgtcatgggcatcaagtaacagggcactccacctggaccctgacacgtgatgcacaggaatgccagctgctatgccatgggtgtggcagtagtaataaagtgaccatctgtatcctcaccacagtgaagcctgtccagggctttctctcctatgcccccatgcctccaggtggccttggatcctgttggttctgtgctctgctcagcgacctttctcccgtgggagttcctgggggttcagcttcatcctacagacagcagcacacactggctgtgcacccttttttttttttttttttttttttttgagatggagtctcgcttttttcgcgcaggctgaagtgcagtggtgtgatcttggctcactgcaacctctacctcctgggttcaagtgattttcctgcctcaccctcccaagtagctgggattacaggctcccaccaccacgcccggctaatttttgtattttcagtagagatggtgtttcaccatgttggccaggatggtcttgaactcctgacctcaggtgatccgcccacctcagcctcccaaagtgcagggattacaggcgtgagccaccacacccggagtgccggttgtttttagcagtttgtcttgttcctggagagactggctcctgcccaggagctcggggagtagggccgcggggtgctgcctcacacctcgagtttggccgtaagcagaggggacattttgtgactgtccccctcctgagcttcccagcagcttttctccaagttacagcccaaaagctcaggtggatttgcaacccaacggtgtctgtgcacctcccactgatgcccgaactgccctggccaagaaacggggccgtcagaacgctgcactaactgcagccttgggcctccatgccagaggccatgcccttccatccaccaccccctggcctgggccctggccctcctggctcgggaactccaggccccttcctcacggatcgagagacgtgtatttaccgcacaggtgcttgtcattctcttgtggcctcttctccagggagatcacagaaggacagggcctcactgaggtctcggacatggaccctttgatagtggcaggagccaggctgggcaagaggcggccacagtcacctcagcagtgccatcaccaccgccattcagcccttccctgagccgggcgcgcccctggctctggccccagtgtcccagttacagctcacaggagcttgtggtgcccagcggctgcttctgattgagagtcgaggtcggaggctttgggaggctgagaggctgctcggtttcacaactgctgagggagacttgggctccatctcaggtctgccccatgtcgccctcaacctccagccaccggtcctccgtgtcccccatggccaggcacggcttgcagacatctgtcgttggctcctctcagccgtcgtgggctgaccctggcacgtcctcctgtggctgagcccagtggggacagctgcttccttttattaccctagaactctcgtctttgatcaggccccctcccctatgccacacagtccctgtcactcgggtgagcccagtagtcatggggaaggcctgcgggttccaaacatccaaaggcttgcgtgcagcatgacagcttgaaaccgatgttttttaccttgatcagatttcagcttggcgggggctttgctcagctttcagtgaggcctgggccgatttcccagcatcccctcctgaggccagcctctgtttcctgtgattttctgcacaaagtgggagggaggagtcttaggaaatggggggccacctcgaaacctaggcctcctctggcttctctgtgccagtgcccccacgctttgtgtctgtgtccccagcccatgggactgtgttattccctgagtgctgccgcatgcccagcccgcactgaggacgtggagccccgaggggcaggatggcctccatggtcacacgtaggaagtggcctccaccctccgatgatcctctccccccctccctttcagcgccttccccgggggtgtcatcagccctcctgcctgtgctttgtcccgtcttctgcaggcgcatgggacgtgctgacaggtcctctgccgggttcctgccttgctatgcgcacgctggtcaccacagaggcctggcccttcttctgtagcagtcccacacccgcaacaggtgtggctgctgaccacctgctttctgcccctctggtcctgaggagggcgcagtgggcactcaggcgtggctgagcagatgtgtgttgccgggaggaggaaggactgctccagtcagggctgaatttcccacccggagcatttctgctgtatttggtgtagcgcctgctgcttaaagctctgattcccagttggcaccctttcccttctgcattgaaaaacatacggatgcatgtcttcttgcagtgaatgtgtattctcccagcctctcttctgggttggggctggaggtggagcggcacacaggagccgcagcgatggaggatgtgcgggtgcagcaccccgtacagcagggatgccaaacccgcgctgagtccctctcaacttctgctttgaagcccagtcacgccattgcctgggttttgctgggcggggctgcatgtgatgttctcctctgtccctcccccagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggtggactgtgacggtgaggccctccccgtcaaggctctgccaagaccctggccctgccctccgggatacgagcttggggctgcctccggcctcacaggagtaggggctctgaaaacctttgcttgcagggagattgccaagtctgtcttttaggcccaacaaggaaaactctgcagttccacccatcctgtcccaccaggtagtgtggcttgaaggcagactgtgagggtctatctcaccttcctgcattaggtcaggagtttcacagaaacctgaggcacattcaggggtgggctgcagaggtccatggctcacaccctggaaaatccgcccccaaaagacagtgctgtctccactgaccagtctgtgggatagtgcttaagcctgagtggtttctatcaacatgtagaatcaggaggtataaagagatttgctcaggcatcctgggccctctctgaccagcaggatcttcctttagatcttgacagtgaaacacatctcttctgtgccccctgtgagttttctttcattcattcattcattcattcattcattcattcattcgagacagagtcttgctctgtcacccaggctggagtgccctggtgtaatctcggctcactgcaacctctgcctccagggttcaatcgattctcctgcctcagcctcccgagtagctgggatgacaggtgcgcaccaccatgcctggctaatttttgtatttttagtagagacagggtttcaccatgttggccaggctggtctcgaactcctgacctcaggtgatccgcccgcctcagcctcccaaagtgctgggattacaggcatgagccaccgcgcccggcctgagttttccttttatgaaggacctgcttggttggttgcctgccacatgttgtcagcaccatgggcccaggactgctgaggagctgttgatgccctcgctctcccagagccaccggctctgttagataattcacatgcagtctggccactgtcctacgtcctcattcacaaagagcagacatttcgtagaagatgagggcctgggagtaacctccctgcatgtttttctataaaggcatagtggttaagtccttccagctcattgaccattggagaattttatggaggctgtagactaggggctggtaaactaagggcccaggggccaaatccagcctgccacctacttttgtaaataaagttttcttggtgcacagccatgcccattcattcatttgcacaatgtctgtggctgctttcatgccaaaagcaggagaactgagtggttatgctggagacctacggccttcaaagccccagacctcacgtctggcccttgacagacagagcttccccagccctgctgcgcatcctggcccagcatgtgctgtgtgtgtgatttcagcttgcaggagccgtggttaggaattgtccctgtgttggtccattttgcattgctatgaaggagcacctgaggccgggtagattatgaaggaaagaggtctgtctggctcatggttctgtaggcagcaccagtatggcacccgcatctgctcagcttctagtgaggtctcaggaagctttgactcatggtggaagtcgaagcgggagcaggtgcatcacatggtgagagagggagcaacggagagagagagagagagagagagagcgcctctccctcttgccctcaccttgagaggagatgccaggctcctttaagtaaccagctcccatgtgaactcacagtgagagcccatttgctactgcggagagggcaccaggcatctgctcccatgacccaaacactgcccaccaggccctacctccaaccttggggtcatattttattctgttctatgctatgctatgctatgccatgccatgccatgccatgctattcctattctattatttgagacagaatctcgctctgttgcccaggctggagtgcagtggcatgatcttggctcactgcaacctccacctcccaggttcaagcgattctcctgcctcagcctcccgagtagctgggattacaggcacacaccaccacacccgggtaatttttgtattttcaatagagatggggtttcaccatgttggccaggctggtctcaaactcctggcctcaagtgatccacttacctcggcctcccaaagtgccatgattacagatgtgagtcactgcgcccagtgagggtcacatttccgttgagatttggaggggcagacgttggagccatctgagccccctcgtcccgctctagcttctcctcccgtgtgccccgcggtgctggtggcaggcccttacgccggttctggctgcacgctctgttccagaagctttcttccctgcttggttaccagaaaatcatcccatccattacaaggacagggtccccttatctcccattcccagggcaggacaccgggggcagggcaggtggggaactgagcaagttctctgggggcaggcgtggctatggctccctctgggtgggcgtctggggaggggtggaggcagccgtcagcgccctggcttgctcttcctccctggccagagactgtggccttgtgctgctcccgtgtgggctgcctgcacctccagtgggttgtgctccctcccctcccctcccctcaagctctgctgagcaccactgccttccacagcccccactctcgggaggcgaggctcctcgtggccattcctgtccttggcacccacccccccaccaacctggtagagccttgggcggggtctgttactccttgcatggcgtagacctccccacagtaggcacctgacacatacctcctggggggcaggcaggaggtgcgttgaggtctcagccctggcagtccctcccctgcgtggcataggcctcgccacagggtcatcgagggtgggtggagactgtactagaccactccccgctggtcctagaaagggtcccatctgtctgctctctgtttggagtccagaccttggttgctgtgccctgcatggtgggctggggggcaccctccagcctctctgagtgcatggcctctccttgcagccatctgcctgcccaaccagttccggtgtgcgagcggccagtgtgtcctcatcaaacagcagtgcgactccttccccgactgtatcgacggctccgacgagctcatgtgtggtgagccagcttctggcacggggaaggggcgtccgggctgggttcccccaggaacgtggagtttaggggaggagacgtgcctttccagcggggctgggggctgtgtgggagactcaggcggctgggaggctccttgcgggaggcagggaagcctttcccagggcagcggccaggaggacagactgtgagctgtgggctcggcggctacagagtctgcctcagtgggcggggctgatggtgtccaggtgcctgcagcacgcacccacccacgggaccttgctgagcagcgtctgtcaggcagcaagattacccgagggctgcagtggtcctgttccctggcagcttactgtctggctgaggaggagtgatgttcacatatgcacacatgtcatgtgcacacacatgtacatgacaacatcccacatgctcctcaaatagcatgacctgtacagtcacggatatagggcctaggggataggaggccaagacagtcagggaagactttccagaggcagtggctcctgaaaggctgtctgattcaggcaggaagggagctgagttcagataggaagtagcaatgagtcattgtgtctggggacatggccactccttcgctgcagagggacctgggctgagagctcctctcttatggctgcagtcgggagagaagtctgttggggggagaagggggcttcctcaagggactccctgtgccctttggcaccttcgtgccaggtcaggcttgaggcctgaaggcagtggtgggggccaccaagggtcgcctcctctgctgggcaagttcccagtctgacgggcctgtgccgtgggccccagctgtgggggcgctgttgatgcgcagccaggcctcgccgccagagcccgcacgcttccattccgctgacttcatcgacgccctcaggatcgctgggccggccctgtgggagagtgaatgtggcttttgccaaagttgagtctggagcctggaaacttccctatgggcagccttgatagtggagtggcccaaggagcccacccagccgaccctgcccctcccgtggctggtgggcggcaccaggggctgcctggctttgctcgttcaccaacatcacccgggctggccagggcgcgctcacttctgccaccaccgagggccctgggcgaaggagtgaataccaggctgccttggcagggatgtgttgagggctgtggggagtcggacagcggcgggggtcagaggaggaggagggtgcaccgtgcaggctgaagggccacgttaccctgaggttggccaggctccccaggcctagcctcccagctcccccactttctccccaccctccaccagtggcaaagccagccccttcagggcgcacggtgtctgcccccaaggagggcccattccgttggggttaatgttggccacctctttctgtttgtctctggcagaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggtaaggagcctgagatatggaatgatctggaggaggcaggagagtagtctgggcagctttggggagtggagcagggatgtgctaccccaggccctcttgcacatgtggcagacattgctaatcgatcacagcattcagcctttcccactgagcctgtgcttggcatcagaatccttcaacacagaggcctgcatggctgtagcaacccaccctttggcactgtaggtgtggagaaagctccttggacttgaccttcatattctagtaggacatgtgctgtgttgtccacaaatcctcatgtaccctagaaatgaatgtgggggcggctgggctctctccagagctgaaggaatcactctgtaccatacagcagctttgtcttgagtgcagctgggatttgtggctgagcagttacaattcctacgtggcccaggcaccaggaacgcaggctgtgtttgtagatggctgggcagccgcaccgcagagctgcaccatgctggtttgtatcacatgggtgaccatggtatgtctaagaaggtggagtccctgtgaggtctgcaggtgcccccacagctccaggccaccttgaggattgcctctgcctgcccagccctgagttccctctcccctgtcctgtcccactgtcaccccaagccggcctcattgggagcctgttggatggcagggtatagatgtaacctgattctctctggggagcggggttatctggcttctcaagagctcctaggagcccacagtggtggcaccatcacagtcgcagcagcccccagagaacgcggccctgtctgttcctggcgtgctctgtgctgccccgcctgggttccctgccccagtcgcaggccccttggaggaggtaccatgtgtctcccgtttcacagatgagccccggggagctcactctagtagtggccagagaggcctgcggctcagggagcggggcacatttccaacaggacacaccgccctggtctgagtctcgtgggtagtgggagcagaggagagcgccctatgtctgtggggcggcttggctgagcctggaagccacctgacctcccccgtcccttccctgccaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccggtgaggggcggggccggggaggggcggggcgggatggggctgtgggcccctcccaccgtcagtgctggccaccggaggcttcccgggttcctgggggctgtgccaccgcctctgaggcatgcttgctttcttcccttttcaaacccttctgcttccttctttaatgacattgttgattgtggataatctgaaaactacacaaaaatataaagagccaaaatctcacccaaatccacctcctagagtggctgttgggctccgtcagcatccaggcggccgtctgtgttccgcacggcccagcccatcgatagccgcctgcaccaggcctgtctgccctctgtgagcctccccacagggttccctccacaaacaccctgttctcccacccagggctggctgcttcctggaaaacagctggatggttttgtgcatgacagacaaacacagggtgattttcgtggctaaaatactccctggagcttttggcagggtgaggggctggctccagctgagccacgccttgagtgaaatgactgtgaggagaataaactgccgctgccctccaggatcactggggctggctggggagaacccccgtttctgggagcacagtcccaggatgccaaggcgagcttggtgccgagatgtgaactcctgagtgtaaacagcgggggctgacttgacatgctttgtatgcttttcatttgttcctgcagctgtatgcccctaaggtgagtccagcccccttctgcttcctctggggcctcgccagtgagccccaccttgctggggctggttcctcctgcccttctgggtatccctcacatctggggtcttgtcttcttgttttatttttcttttttttttgagacggagtttcacttttgttgcccaggcttcagtgcaatggtgtgatctctaggctcaccgcaacctctgcctcccaggttcaagcagttctcctgcctcagcctccctagtagctgggattacaggcatgtgccaccacgcccagctaattttgtatttttagtagagatggggtttctccatgttggtcaggctgatcttgaactccctacctcaggtgatccgcccaccttggcctcccaaagtgctgggattacaggcgtgagccaccgcacctggcctttttcttttcttttcttttcttttttctgagacagggtctcgctctgtcacccaggctggagtgcaatggtgtcatcatggctaactgcagcctctaccttctaggctcaagcaatcctcccatctcagcccctaagtagctaggactgcacgcatgcatccccatgcccagctaatatttacattttttgtagagatgaagtttcactatattgcccaggctggtctccaactcctggactcgagcgatcctcctgcctcggcctccccaggtgctgggattacaggcgtgagccaccgtgcctggcctggggtattgtcttcttatggcacctgactgtggtgggccctgggaaggaagtagcagaagagggttcttcttggtttcctggacagtaactgagtgttctggaggccccagggcctggctttgtttagggacaaagggaactggtaaccagaagccgagagtttaaacacccactgcccttcttccctgctcctgctgctgcaacccagcttaaccagccaggagtgctaggaacccaagcagggcccccgagcacacagcaggcagctcacgaattctcttttcctgttctcccttgggagctgggaggatcttaatcaggcaataagagatggcactgagcagccagctaattttttaaatcactttattgtttaaccatatgactcacccacttaaaaaagggtacagttcagtgggttttagtgtattcacagatgtgtgcaaccctcaccacagttaattttagaacattttcctgcccctaaaagaaactctgcatgaagccagctgtttttaaattagcaaagttattttgcatcctttaaatatatgttcatggtacaaaattcaaaagatacagaagagtctgcagtccaaagagactccgcccccatgacgccaagcaggactccctgggaggcatggcctcctgcagtgtgtttcttctatgtccccccaggggtcatctgtacatatgcaagcatacaagagcgtggactttgttttccaagccagaagataattgtagatttatgtgcagttgtgagaaagagcacagacccatttatcctctgcctggtttcccccagtgctgcctgccatcttgcatgacttccattcctatcataagcaagacactgataacgattctttcaccttattcagattgacataagtgttttttgtttgttcttgagacaaacttcctctgtcacccagtgggagtgcagtggcacaatcacagctcactgcagcctcaaactcctgggctcaagcgattctcctgcctcagtcccctcaagtagctcagatggcaggtgtgcaccatcatgccaggctaatttttaaattttttgtggaggtgaggcctcactaaatttcctgggctagtcttgaactcctgagctaaagtgatcctcctgcctcagcctcccaaagtggtaggattacaggcatgagccactgcgcctgggctgacatatgtgttttcgtaagcccgaaagatagcatctgaagagtcaacattgagccttgccttttgctgctaatgatgtataaaagctgctgttctgagcatttcggaggctcccagctgccgtgtgcaccctgcctagagctctaccgtaacccatctccgggaggaggtgctattgttttcctcattttgcaacaaggaggctgaagaactgagcatgaaccactggcctgggtcgttcggttggtaggcagtggggccaggccatccaactcacaaccaccttctactctgcttcccccgcaccctgaagtttgttctgttttgaggacacagccgtcacattcttggtggctgaacagcactccttgtcaggtgtggctgggcccccactggagggcatcatggtcctctctcctgctgcggttgaaccttggctgtttcaaccactcctgccaagtggccctctgaaagggacagtccatcttttctcagcagagggccacactggcaaaacggtccctggcaccctttctctccacctgtctaatatagagtaaaaatggtatcatgttaagatcttcatttatatttattttatcatgaatgatgtaagcatcattttgtgtgtttaagaacctttgggcccagcgtgatggcttgcagctgtaatctcagcactttaggaggctgagatgagcggatcacttgaggccgggagtttgagaccagcctggccaacatggagaaaccccgtctctagtaaaaatttaaaaattagccgggtatggtgatcccagctacttgggagtctgaagcatgagaattgcttgaacatgggaggcggaggttgcagtgagccgagatcgcgccattgcactccagcctgggcgacagagcgagactctgtctcacaaaaaaaaaaaaaaaagaaaagaaaagaaattatcaatctcctcttttatggcatatatatatatatatatatatatatatatttatttccctttcttggttatgttcataaaggcctcccctgctctgatcataaaaaacaacttattttcacactctctctcttttttttttgagacagagttttgctcctgttgcccaggctggagtgcagtggcgcaatctcagctcactgtaacctccgcctcccgggttggagtgattctcctgccttaccttcccgagtagctgggattataggcatgcaccaccatgcctggctaattttgtacttttagtagagacgggggtttctccatgttggtcaggctggtctcgaactcgcgacctcaggtgatccacccacctcggcctcccaaagtgctgggattacagacgtgagccaccatgcccagcccacactctctttcttaacgtcctcctcctttcgttttacgttcacatctttaattcttctgggatgtaattagatttgatgagcaaggtgggcatccagcttgtttcttggctgatggcttatgggtggcgtgaattagtcggggtctatcaggaggcagaaactctatgagaatttgaacagagaaagttccgtctacaggcttattaccagggactggaatagcagaaattgaacagtgagatgtacagagaactctaagaatgcaggaataggccaggcatggtggctcacacctgtcatcccagcactttgggagaccaaggcgggtggatcacctgaggtcaggagttcgagaccagcctggccaacatagtgaaaccccatctctactaaaaatacaaaaaaattagctgggtgtggtggcgcatgcctgtaatcccagcttctcgggagtctgaggctggagaatcacttgaacctgggaggcagaggttgtagtgagccgagatcatgccattgtactccagcctgggcaacaagagcgagactcagtcaaaacaacaacaacgcaggaatagcagatgagccgaggtggggcctccccagcccccaccccccaccccgcaccctgggccgagatccagtcctctttgaatagggcctgggcgtggttcacgggacatctgagacattgccgaggcgctgcactggtggatcttgccagaagtctgcccagtgcagatttgggcagaatctcaaactgccttgggatgtaggagagaaaccaggcctggtcaagttcatgggaagaggtggaaacagaccccataggctggggcttgggcagctgtaggaagccctctctgctgcctccctgcctgctctctgctttgaagcatcttccccagtgcccccagtctcatgccctctcaacgttggggtcaaatcctgaggaatacccagactggctctctgggccaaagaggaccctctccagaaagagcagggcccagtgcggcttcctaaagggcaggggaagggcctggccactccccagaggctactcaccagccatcaggatagccccaggaagcaggccttctcgagcccattttattactttattttattattttatttaattttaaatttattttttgagacagagtctcactctgttgcccaggctggagtgcagtggtgcgatctcaacccactgcagcctctgcctccagggttcaagggattctcccacctcagcctcccaagtagctgggattacaggtgcccgccaccacacccggctaattttcatatttttagtagagacgaggtttcaccatgttggccaggctggtctcgaactcctgacctcaagtgatccgcccgcctcggcctcccaaagtgctaggtcaagcccattttaaagttgaagaaactgaggctgaggtaaattccctccccagggatcctgctgcagccagaaggtggtaaaacaggacttcacccgggtctgtctggcgtgaaaggcagtgttcttgtaccaccctagggggcctgagagaactgagtccctcgggcataactgacagttctgttcccattattccgcaggggctcggatctggctgtatgctttccaggatggccttggagacccacataagccctacaccctttgggaagctgcatgttgggttggggtgccgtcagtggcacttgtggaaggtgcagacctgtgtgggtgtgtgggcccagggcccctggtcccttcctccctttgtagggctggttgtgtgctgcctggacctggggggcacgttcacgtggtgaatttgtctatttactatccccgctttggggctggtgccagcacaggcccttgtgaagggggtgcctttgtctggagtgggactgtggcccctccctcagcgtggtgacttctgtgtcagggcttcagcagggacgcagagcccctgagtgttcggaacaagggcgtcattgcaggagttagactgtgtgtgatggagggaggaggggcaggaggaaaggtcagaaggagagttcctgggaaggtccctgaggagcctggtgaggtgctaactggtgtggaggacactcagggcctgtggggacatctcctactgctgggggccagccacaaagggaactggccgaagtcctgtccccgccttcacagcccagcatctggtcacaaggcaggtacttggaagggcgcgggcacctgggccaaaagtgcctgggttccctttgcctttcactgagatgaccttcggggcaggtggctgctgcctcccctcctgtccccaggttttgccaactggccagaggaaggggtcctgggaagcaggggggccagaagccctctctgcaaggaaagcccgaggggtgtgggaggaaggaaggaatgcccaggctggcgaggctctaagtcaccctggcttggctctcctcagatcctgaacccgccgccctccccggccacggacccctccctgtacaacatggacatgttctactcttcaaacattccggccactgcgagaccgtacaggtaggacatcccctgcagccctccatggccattgggttcccgccagcccgtggtggaggggcctaatccccatgccactgatgaggggaggtattctgggtgctagtgggcaggtgccgggcccagccctgcctccctctgctctgccaaccacactaggctgcctccccagacaagctcagcgggcactgcatgttgggttcagaaatcagcagaactccacgttctgagctgctcttcaagttgctcctatgggggttacttttaagctgggaaatggctgtggcgtcgaggggccgggggcttgggctccaaactctgactgtgtgtttgagtccggctgtggaaacctagccattgagatgccccctcttggtggctctgtcctcttaggatgggacaagtctgtgaaggctgctgcagcacccaccgtagacccctaatcgtgtgacgtcaccaggatggtccgggctgctcacttgccacagtggcctgtttgagcccgggaagccaacggggctgctcagctggacaccagccccccgagctgcccatgttggggtcacaggccccacctccctggttggggaggggcaactgagagtgtggagaggtgggacccaggtgtgctggtctccgcaggggctggatcagagcctgggatgggcagggtgagcctcctgacctttaacccagtggtgtcaggcaacgtggcccacccgccagccgcaccaggccccacccccgcaggtgaaggggtgggataggctgggcctgggccaggacacctctggaccacgcattcctcattgcttgggtccctggagcagcagggcctcccgagtgtggtgccgcctgccacctagtggccatttccacgaactcccaggcctggctggggagccggaactgcagcctccatttccaccccactccgggtcgggccacctccctgatgcctcagtattatatcaaactgtcacagtctgtcccacagccttacagaccactgtctccagaatggtcacatccacactgggcagcccagtctcgctagttcctcgtcccacctcctgcctttgctcatgcccgtcctgctctgggcccaccgcggacacatcttccccccgcccgccgtctgacctcacagcagctgggccccaagaggagtatcctgtcctgctgcacttttctcaacacccggtgttggctgcaccttcccacccattgcaggcccctctgtgacaggacgggggctcctaaacacaccacagttccgagtctgaactcacacagtgggatgcggcgtttctgggccacagttgggtgcaggtagcctctgggaggatgggaggtcaggagccatcttgcgagtcaggttgcttgaactcaggatggaagtgttccgggcccattggttgctgtattagcctgttctcacgctgctaataaagacatacccaagactgggtaattgtaaaggaaagaggtttaacggactcacagttccacctgcctggggtggcctcacaatcatggtagaagacaaggaggagcaagtcacatcttacatggcttcagggaacagacagcatgagaaccaagcgaaaggggtttccccttgtaaaaccatcaagtctagtgagatttattcactaccacgagaacagtatggggggaaccacccccatgattcaatcatctcccactgggtccctcccacagcacgtgggaattatgggagtacaattcaagatgagatttgggtggggacacagccaaaccctatcggttgccaacatttacagtaacagtgttaggtgaacagttgtccagtctcctgttttgtcggacactgtttctagcaccttccaggcagaatctcatgtatccttcactttcgaaatgggtactatttcatccccacttttatcaatgagaaactaaagctcgaagaggtcaagtaagttcctggccaaggtcagctagcaggctctagaggcctcgttctccttagaggcagccttgccagggcccaggcttggcaggctgcagggcaggtgcgggcatgcccatggtagaggtgggaccattgaggctcagagagggtaagtgatgagccctggcgacacagcggggtgggtccagagtccggcctgcatcttctggagctggccagtggacaggcctttcccgttcacagccccggggctgctgtgcccaccagggcggatgtgcctaccgaatcccactcctctgtgtgtgtccctttcaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaactgccattcttttgtgccctgtgtgcatttgagttgtgtgtccccgtggagggaatgccgacccccggaccaccatgagagtcctcctgcacccgggcgtccctctgtccggctcctgcagggaagggctggggccttgggcagaggtggatatctcccctgggatgcatccctgagctgcaggccgggccggctttatgtgcgtgtggcctgtgccgtcagaaagggccctgggcttcatcacgctgttgctgttcgtcttcctcagattcttagtcttttttttttttttttttttttgagacggagtctttctctgtcatccaggctggagtgcagtggtacaatctcagctcactgcaagctccgactcccaggttcaagtgagtctcctgcctcagcctcccgagtagctgggactacaggtgcgcgccaccacacccgcccagctaatttttgtatttttagtagagatggggtttcaccatgttggccaggatgatctcgatctcttgacctcgtgatccgcccacctcggcctcccaaagtgctgggattataggcatgagccactgtacccagctgactcttagtcacttttaagaaggggactgtgccttcatttttcactgggccctgcagaatatatgcctgggctctgggctcttctgaacctgtgttggcttccatctgacctctctgtgccagcccaaggctgctgctcttcctgagggcaaggagccccatgactgcgtgttgactcgctggatggggctgctgagcccactctgccacaccacgtgcccctggcagggagggaatccctgggtcctcacaggaacagtcagcaagccacacctgacgcctgctgtgggcccatccctgcggtgctggagaagacagacaaggcctggtcactgcctctgcagggtccccagtccgtggaaggagacagtaatctaggcattttcggtggggaagctgagctgttctcgtgtcctgaaggccaggcgggaacagccgtcttcagagggaagggagaaaatgcacatcgcatcagtggagaagggcctgacttccctcagcatggtggagggaggtcagaaaacagtcaagcttgagtattctatagtgtcacctaaata

SEQ ID NO: 10 - DNA, 8705 bp, Homo sapiens
ggactcaggggcagcagggaggtacacccatggttagtgggcggaccatagggggtaatgagagggtgaatcgatggaacctgggggacacaatcgaagtggttccagagtcgggctgtactaattaaagagacggggcagtggacaggcattttcagttgactgcccagggagtgttctgcccaacagggaggatatgcgtacagaatcatactcgatcagcatgagtccaattcagaccgtacatcagtggagatatgggtcccccgatgactccgtggaacactgatgtttgtgacaggggagtacagcaccagccatcagcaggccagtaaatcataccggcctgcgaaattggactcagacccggatccaccctgaccgacgtcccaagcccccaccccccaccccccaccatgggccgagatccagtcctctttgaatagggcctggccgtggttcacgggacatctgagacattgccgaggcgctgcattggtggatcttgccagaagtttgcccagtgcagatttgggcagaatctcaaactgccttgggatgtaggagagaaaccaggcctggtcaagttcatgggaagaggtggaaacagaccccataggctggggcttgggcagctgtaggaagccctctctgctgcctccctgcctgctctctgctttgaagcatcttccccagtgcccccagtctcatgccctctcaacgttggggtcaaatcctgaggaatacccagactggctctctgggccaaagaggaccctctccagaaagagcagggcccagtgcggcttcctaaagggcaggggaagggcctggccactccccagaggctactcaccagccatcaggatagccccaggaagcaggccttctcgagcccattttattactttattttattattttatttaattttaaatttattttttgagacagagtctcactctgttgcccaggctggagtgcagtggtgcgatctcaacccactgcagcctctgcctccagggttcaagggattctcccacctcagcctcccaagtagctgggattacaggtgcccgccaccacacccggctaattttcatatttttagtagagatgaggtttcaccatgttggccaggctggtctcgaactcctgacctcaagtgatccgcccgcctcggcctcccaaagtgctaggtcaagcccattttaaagttgaagaaactgaggctgaggtaaattccctccccagggatcctgctgcagccagaaggtggtaaaacaggacttcacccgggtctgtctggcgtgaaaggcagtgttcttgtaccaccctagggggcctgagagaactgagtccctcgggcataactgacagttctgttcccattattccgcaggggctcggatctggctgtatgctttccaggatggccttggagacccacataagccctacaccctttgggaagctgcatgttgggttggggtgccgtcagtggcacttgtggaaggtgcagacctgtgtgggtgtgtgggcccagggcccctggtcccttcctccctttgtagggctggttgtgtgctgcctggacctggggggcacgttcacgtggtgaatttgtctatttactatccccgctttggggctggtgccagcacaggcccttgtgaagggggtgcctttgtctggagtgggactgtggcccctccctcagcgtggtgacttctgtgtcagggcttcagcagggacgcagagcccctgagtgttcggaacaagggcgtcattgcaggagttagactgtgtgtgatggagggaggaggggcaggaggaaaggtcagaaggagagttcctgggaaggtccctgaggagcctggtgaggtgctaactggtgtggaggacactcagggcctgtggggacatctcctactgctgggggccagccacaaagggaactggccgaagtcctgtccccgccttcacagcccagcatctggtcacaaggcaggtacttggaagggcgcgggcacctgggccaaaagtgcctgggttccctttgcctttcactgagatgaccttcggggcaggtggctgctgcctcccctcctgtccccaggttttgccaactggccagaggaaggggtcctgggaagcaggggggccagaagccctctctgcaaggaaagcccgaggggtgtgggaggaaggaaggaatgcccaggctggcgaggctctaagtcaccctggcttggctctcctcagatcctgaacccgccgccctccccggccacggacccctccctgtacaacatggacatgttctactcttcaaacattccggccactgcgagaccgtacaggtaggacatcccctgcagccctccatggccattgggttcccgccagcccgtggtggaggggcctaatccccatgccactgatgaggggaggtattctgggtgctaatgggcaggtgccgggcccagccctgcctccctctgctctgccaaccacactaggctgcctccccagacaagctcagcgggcactgcatgttgggttcagaaatcagcagaactccacgttctgagctgctcttcaagttgctcctatgggggttacttttaagctgggaaatggctgtggcgtcgaggggccgggggcttgggctccagagtctgactgtgtgtttgagtccggctgtggaaacctagccattgagatgccccctcttggtggctctgtcctcttaggatgggacaagtctgtgaaggctgctgcagcacccaccgtagacccctaatcgtgtgacgtcaccaggatggtccgggctgctcacttgccacagtggcctgtttgagcccgggaagccaacggggctgctcagctggacaccagccccccgagctgcccatgttggggtcacaggccccacctccctggttggggaggggcaactgagagtgtggagaggtgggacccaggtgtgctggtctccgcaggggctggatcagagcctgggatgggcagggtgagcctcctgacctttaacccagtggtgtcaggcaacgtggcccacccgccagccgcaccaggccccacccccgcaggtgaaggggtgggataggctgggcctgggccaggacacctctggaccacgcattcctcattgcttgggtccctggagcagcagggcctcccgagtgtggtgccgcctgccacctagtggccatttccacgaactcccaggcctggctggggagccggaactgcagcctccatttccaccccactccgggtcgggccacctccctgatgcctcagtattatatcaaactgtcacagtctgtcccacagccttacagaccactgtctccagaatggtcacatccacactgggcagcccagtctcgctagttcctcgtcccacctcctgcctttgctcatgcccgtcctgctctgggcccaccgcggacacatcttccccccgcccgccgtctgacctcacagcagctgggccccaagaggagtatcctgtcctgctgcacttttctcaacacccggtgttggctgcaccttcccacccattgcaggcccctctgtgacaggacgggggctcctaaacacaccacagttccgagtctgaactcacacagtgggatgcggcgtttctgggccacagttgggtgcaggtagcctctgggaggatgggaggtcaggagccatcttgcgagtcaggttgcttgaactcaggatggaagtgttccgggcccattggttgctgtattagcctgttctcacgctgctaataaagacatacccaagactgggtaattgtaaaggaaagaggtttaacggactcacagttccacctgcctggggtggcctcacaatcatggtagaagacaaggaggagcaagtcacatcttacatggcttcagggaacagacagcatgagaaccaagcgaaaggggtttccccttgtaaaaccatcaagtctagtgagatttattcactaccacgagaacagtatggggggaaccacccccatgattcaatcatctcccactgggtccctcccacagcacgtgggaattatgggagtacaattcaagatgagatttgggtggggacacagccaaaccctatcggttgccaacatttacagtaacagtgttaggtgaacagttgtccagtctcctgttttgtcggacactgtttctagcaccttccaggcagaatctcatgtatccttcactttcgaaatgggtactatttcatccccacttttatcaatgagaaactaaagctcgaagaggtcaagtaagttcctggccaaggtcagctagcaggctctagaggcctcgttctccttagaggcagccttgccagggcccaggcttggcaggctgcagggcaggtgcgggcatgcccatggtagaggtgggaccattgaggctcagagagggtaagtgatgagccctggcgacacagcggggtgggtccagagtccggcctgcatcttctggagctggccagtggacaggcctttcccgttcacagccccggggctgctgtgcccaccagggcggatgtgcctaccgaatcccactcctctgtgtgtgtccctttcaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaactgccattctttcgtgccctgtgtgcatttgagttgtgtgtccccgtggagggaatgccgacccccggaccaccatgagagtcctcctgcacccgggcgtccctctgtccggctcctgcagggaagggctggggccttgggcagaggtggatatctcccctgggatgcatccctgagctgcaggccgggccggctttatgtgcgtgtggcctgtgccgtcagaaagggccctgggcttcatcacgctgttgctgttcgtcttcctcagattcttagtctttttttttttttttttttttttgagacggagtctttctctgtcatccaggctggagtgcagtggtacaatctcagctcactgcaagctccgactcccaggttcaagtgagtctcctgcctcagcctcccgagtagctgggactacaggtgcgcgccaccacacccgcccagctaatttttgtatttttagtagagatggggtttcaccatgttggccaggatgatctcgatctcttgacctcgtgatccgcccacctcggcctcccaaagtgctgggattataggcatgagccactgtacccagctgactcttagtcacttttaagaaggggactgtgccttcatttttcactgggccctgcagaatatatgcctgggctctgggctcttctgaacctgtgttggcttccatctgacctctctgtgccagcccaaggctgctgctcttcctgagggcaaggagccccatgactgcgtgttgactcgctggatggggctgctgagcccactctgccacaccacgtgcccctggcagggagggaatccctgggtcctcacaggaacagtcagcaagccacacctgacgcctgctgtgggcccatccctgcggtgctggagaagacagacaaggcctggtcactgcctctgcagggtccccagtccgtggaaggagacagtaatctaggcattttcggtggggaagctgagctgttctcgtgtcctgaaggccaggcgggaacagccgtcttcagagggaagggagaaaatgcacatcgcatcagtggagaagggcctgacttccctcagcatggtggagggaggtcagaaaacagtcaagcttgttgctgggtgacagtgcatttaataatcaaaatataggctgggtacggtggctcatgcctgtaatcccagcactttgggaggctgaggcaggtggatcacttgaggccaggagtttgagaccggcctggccaacatggcaaaacctcaactactaaaatacaaaaactagccgggcgtggtggtgcacgcctgtaatcccagctacttgggaggctgaggcaggagaattgcttgaacctgggaggcggaggctgcagtgagccgagattgtgccactgcactccagcctgggcaacagagcaagactctgtctcaaaaaaaaaaaaaaaaaaagcaatacaaaatacaaatatcactttcactaaaagaagggatggaagacccaaaacaaacagaaaacaacaaaatggcaggagtaagtccccacttatcaataataacattgactgtaaataggctaagctctgcaatcaaaagagtgggccaggagcggtggctcacgcctgtaattccaacgctttgggaggctgaggcggatggatcatttgatgtcacgagttttaagaccagcctggccaacaaggtgaaaccccatctgtactaaaaatacaaaaattagccaggcggtagtggcacgcacctgtaatcccagctacttgtgaggctgaggcaggagaatcactggaggctgggaagcggaggttgctgtgagccaagatggagccactgcactcccacctgggcgacagagtgagatcctgtcttaagaaaaaaaagagtggatgaatggatcaaaaaacaagacccaaccatctcttgcatacaagaaacacactttacctataaaaacacactaggccaggtgtggtggctcacacctgtaatcccagccctttgggaggcctgactggcagatcacctgaggccaggagtttcagaccagcttgaccgacatggcaaaaccccatctctcctaaaaatacaaaaaaacaaaaaaaagaaaaaggctggaagtagtgatgtgtgcctgtagccccagctacttgggaggctgaggcaggagaattgcttgaatccgggaagtggaggttgcagtgagccaggatggtgccactgcactccagcctgggtgacagagcgagaccctgtcataaaaaaaaaaagaaaagaaaagaaaaacgagaaaaacaaacacaaaattagtagaagaaaagaaataataaagatcagaacaggccaggctcatgggcacagtggctcaactcctacctgctcaggagtttgagaccagtctggccaacatggcaaaaccccatctctcctaaaaatatgaaaaaaaaaaaataggctggatgtggtgatgtgtgtgtgcctgtagccccagctacttgggaggctgaggtgggagaatcacttgagcccaggaagtggaggctgcagcgagtcatgaatgcaccctgcactctagctgggtaactggagtgagattctgtctcaaaaaagcaaagaccagagcagaaataaatgaaatggaaatgaaggaaacaatgcaaaatgatacaaaaagttttttcgaaaagataaacaaaatcaacaaacctttagccagattaagaaaaaaagagagaagacccaaataaataaaatccgagattaaaaaggagacattaccactgataccacagaaattcaaaggatcattagaggcaactatgtgcaactatatgctaatgaactggaaaacctagaagaactgggtaaatttctagacacatacaacctatcaagattgaaccatgaagaaatccaaaacctgaacaggccgggcacggtggcttacgcctgtaatcccagcactttggaaggcctgagatcaggagttcgagaccagcctggccaacatggtgaaaccccatctctactgaaaaaatataaaaattagccgggcgtggtggcgggtgcctctaatgtcagccactcgggaggctgaggcaggaaaatcacttgaacctgggaggcataggttgcagcgagccgaggttgcaccactgcactccagccttggcgacagagccagactccatctcaaaaaaattaaaataacaaaaacctgaacagaccaataacaagtaatgcgatgaaaactgtaataaaatgtttcccaacaaagaaagcccaggaacaaatggcttcactgctgaattttaccaaacatttttttttttttgagacggagtctcgctctgtcgcccaggctggagtgcagtggtgtaacctcggttcgctggtaacttatgcctctcaggctgcaagtgattttcctgcttcaggccccccgagtggctggaaattagatggtacttgtcaaacaaggcctggctaaatttctatatttccttcaagtagaagatgtgcttccaacaaaggttgggttacggctggcttctgaaaatcttggatttcaaggctccccaaaag

SEQ ID NO: 11 - DNA, 66933 bp, Homo sapiens
tataatcaagcgcgttccgtccagtccggtgggaagattttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtatcgtcggtctgattattagtctgggaccacggtcccactcgtatcgtcggtctgataatcagactgggaccacggtcccactcgtatcgtcggtctgattattagtctgggaccatggtcccactcgtatcgtcggtctgattattagtctgggaccacggtcccactcgtatcgtcggtctgattattagtctggaaccacggtcccactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgacgagctcgcgagctcggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtccgagctcatcgctaataacttcgtatagcatacattatacgaagttatattcgatgcggccgcaaggggttcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattcgagctcggtacccggggatcctctagagtcgacctgcaggcatgcaagcttctcttgtgccggttgtacgctgtcaggtcacactggtgagttaggcagggcacagatgcccagagcagagggaactttccttggggattcaacacgtgcaagtcttaggggctggcaaatcctgccctcagctagagagggggcttttatttgagaccagaatcacctgagcatcctcctgtccccagctgtgtccagcctgtctgcagggacatcctgagaggaccaggctctcccctcatccacctgcctaagtgccactctgaaccctgtccacctgtgccgtggaggggcgtgacctcaagctgctcagccagcagcaggcttggccctggggggcagcagagacccaggtggctgtggggtgggtgcttcgtggcgtggttctgaaacttcgttggaagtgtgtggacagtgccttgcctgttctctgtgggaccctatttagaaacgaggtctgagttactgggggtcatcactgtgttctgatggcccagctgtgtggaggccgcggtgcagccccatccaaggagccagggccctgggtctagccgtgaccagaatgcatgccccggaggtgtttctcatctcgcacctgtgttgcctggtgtgtcaagtggtcgtgaaactctgtgttagctcttggtgttcctgaaagtgcccccgggtctcaggcctcagaaccagggtttcccttcatctcggtggcctgggagcatctgggcagttgagcaaagagggcgattcacttgaaggatgtgtctggccctgcctaggagccccccggcacggtgctggggcctgaagctgccctcgggtggtggagaggagggagcgatgaagtggcgtcgagctgggcaggaagggtgagcccctgcaaggtgggcatgctggggacgctgagcagcatggccagcagctgggtctgcagcctggtacccggcgggacttgtggttggggctggtttgtggccaggagaggggctggcaggagacaagggggactgtgaggcagctcccacccagcagctgaagcccaatggcctggctgtgtggctctcagctgcgtgcataacctctcagtgcttcagttctctcatttgtaaaatgaggaaacaaacagtgccagcctcccagaggtgtcatgaggatgaacgagtgaccatgtagcatgggctgggtgcgtgtcacctaacatcaccagcctttgcaaggagagccctgggggcctggctgagtatttcccttgcccggcccaccccaggcctagacttgtgcctgctgcaggcccttgacccctgaccccattgcacctgtctccacaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatggggtaagacgggcgggggctggggcctggagccagggccaggccaagcacaggcgagagggagattgacctggacctgtcattctgggacactgtcttgcatcagaacccggaggagggcttgttaaaacaccggcagctgggccccacccccagagcggtgattcaggagctccagggcggggctgaagacttgggtttctaacaagcaccccagtggtccggtgctgctgctgggtccatgcgtagaaagccctggagacctggagggagccctttgttcccctggcttcagtttcctcatctgtagaatggaacggtccatctgggtgatttccaggatgacagtagtgacagtaagggcagcctctgtgacactgaccacagtacaggccaggcctctttttttctttttttttttttgagatggagtctcactctgtcgcccaggctggagtgcagtggtgtgatctcagctcactacaacctctgcctcctgggctcaagtgattctcctgcctcagcctcctgagtagctgggattacaggtgcctgccactgtgcttggctaatgtttgtatttttggtagagatggggtttcaccgtcttggccaggctggtcgcaaactcctgacctcaggtgatccacctgcctcagcctcccaaagtgctgggattacaggcatgagccaccacgcccggtcaggccaggcctcttttgaacactttgcacaccatgggtcttttcatccaggggggtaggtacagttgtacagttgaggacactgaagcccagagaggctcagggacttgcccagggtcacacagcaggatgtggcaggtgtggggctgggcctggcagcgtggctccagctttccagcatagaaatctgtgaaagcagatagtttgtcggtcggtaggggagactttctgagacccgccccagcggctcagagggtagtagccaggggccttcctgggggctcataacccagaacactgaatgggaaaaccctgatggaggaggcgcagtggagctgtgggtgccgatgggaagtcccagaggagctgggaggtcagtagcggtgctgccctctgtggagcacttagtgggcaccaggtgtgtttccaggttcatggccctgggacctgaagctcagaaggtgaagtaacttgcccagggcacccgtcgggcagcggcgggcagaggatttgtgggctgtggagcctgtgctcgtggcccagccctgggggttgtgagtgtgctggccggggagcttttcctgcaagtggactggtgtctaggagccagcatgtcaggcagcaggcagcgggagtgcagcaggcagcgggagcacagcaggcagagggcggggctcgagcagccatccgtggaccctggggcacggaggcatgtgggagagggctgctccatggcagtggctgaagggctgggttgtgccccgaggagggtggatgagggtaagaagtggggtccccaggggctttagcaagaggaggcccaggaactggttgccagctacagtgaagggaacacggccctgaggtcaggagcttggtcaagtcactgtctacatgggcctcggtgtcctcatctgtgaaaaaggaagggatggggaagctgactccaaggcccctcctagccctggtttcatgagtctgaggatcccagggacatgggcttggcagtctgacctgtgaggtcgtggggtccagggaggggcaccgagctggaagcgggaggcagaggggctggccggctgggtcagacacagctgaagcagaggctgtgacttggggcctcagaaccttcacccctgagctgccaccccaggatctgggttccctccttggggggccccagggaacaagtcacctgtcctttgcataggggagcccttcagctatgtgcagaaggttctgctctgccccttcctccctctaggtgctcagctcctccagcccactagtcagatgtgaggctgccccagaccctgggcagggtcatttctgtccactgacctttgggatgggagatgagctcttggcccctgagagtccaagggctggtgtggtgaaacccgcacagggtggaagtgggcatccctgtcccaggggagcccccagggactctggtcactgggcttgccgctggcatgctcagtcctccagcacttactgacaccagcatctactgacaccaacatttacaaacaccgacattgaccgacaccgacatttaccgacactgacatttaccaacactgtttaccaacactgacatctactgacactggcatctaccaacactgacatttaccgacactgacatttaccaacactatttaccaacactgacatctactgacattggcatctaccaacaccaacatttaccgacaccaacatttaccaacactgaaatttaccgacaccgacatttaccgacaccgtttaccaacaccgacgtttaccgacaccgacatttaccgacactgatatttaccaacactgacatctactgacgctggcatctactgacaccgatgccagcatctaccaacaccgacatttaccaacactgacatttactgacactgatatctactgacactggcatctactgacaccaacatttaccaacaccagcatctaccaacaccgacatttaccaacaccagcatttaccaacaccgatgtttaccaacgccgacgtttaccgacgccagcatctaccaacactgacatttaccgacaccgacatttaccgacactgacatttactgacactgacatctactgatactggcatctaccgacactgatatttaccaacgccagcatctactgacactgatgtttaccaacaccgacatttacgagcaccgacatttactgacaccaatatttactgacatcaacatttagccatgtgatgggggccggcttgggggcaggccttgctcttggcactggggatgctgcagagaccagacagactcatggggtcatggacttctgcttcttctccagcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgaggctcctgtggacatgtttgatccaggaggccaggcccagccaccccctgcagccagatgtacgtattggcgaggcaccgatgggtgcctgtgctctgctatttggccacatggaatgcttgagaaaatagttacaatactttctgacaaaaacgccttgagagggtagcgctatacaacgtcctgtggttacgtaagatgttatcattcggccaggtgcctgtagacacagctacttggagactgaggtgggaggatcgctggagtccaagagtttgaggccagcccgggcaaaggggacacaggaatcctctgcactgcttttgccacttactgtgagatttaaattatttcacaatacaaaattaagacaaaaagttaatcacatatccactgccctgcttaagacagaaaacatgggtgttgttgaagccagaggcagctgctggcctgagtttggtgattggttcctaagcagttgaaggcagttttgtttttccatagatgtctgttctccctttgctgggtgcagcctcgccctgctgctgtggtcgggtttcagtggcctcgtcccgtggacgcagcctcgccctgccgctgtggtcgggtttcagtggcctcgtcccgtggacgcagcctcgccctgctgctgtggtcgggtttcagtggcctcgtcccgtggacgcagcctcgccctgccgctgtggtcgggtttcagtggcctcgtcccgtggacgcagcctcgccctgccgctgtggtcgggtttcagtggcctcgtcccatgggcgtgctttggcagctttttgctcacctgtggagcctctcttgagcttttttgtttgttgtttgtttttgtttgattttgtttgattgtttgtttttgttgtcgttgttgttgcccaggctggagtgcagtggcgcgatctcagctcactgaaacctctgcctccttgggttcatgccattctcctgcctcagcctcccacatagctgggattacaagtgcccgccaccacgcctggctaaattttgtatttttagtagacagggggtttcaccatgttggtcaggctggtctggaactcctggtctcacatgatccacctgcctcggcctcccaaagtgttgggattacaggcgtgagccaccgcgcccagcctctgttgagcatattttgaggttctcttggtgccagtgatatgtacatgtgtccccatcgcaccatcgtcacccattgaggtgacattggtgcctctcctcggggtggatgcctccctctgtttccagcaacttctgaaggattttcctgagctgcatcagtccttgttgacgtcaccatcggggtcacctttgctctcctcagggctcccaggggaggcccgaatcaggcagcttgcagggcagggcaggatggagaacacgagtgtgtgtctgtgttgcaggatttcagaccctgcttctgagcgggaggagtctcagcaccttcagggtggggaacccagggatgggggaggctgagtggacgcccttcccacgaaaaccctaggagctgcaggtgtggccatttcctgctggagctccttgtaaatgttttgtttttggcaaggcccatgtttgcgggccgctgaggatgatttgccttcacgcatccccgctacccgtgggagcaggtcagggactcgcgtgtctgtggcacaccaggcctgtgacaggcgttgttccatgtactgtctcagcagtggttttcttgagacagggtctcgctcgctcacccaggcgagagtgcagtggcgcaatcacggctcgctgtagcctcaatctccctgggctcaggtgatcctcctgcctcaccctctgagtagctgggactacagacacataccaccacacccagctagtttttgtgtattttttgtggggggagatggggtttcgctgtggtgcccaagctgatctcaaactcctgaggcacaagcgatccacctgcctcggcctcccaaagtgctgggatgacaggcatcagccgtcacacgcagctcaatgattttattgtggtaaaataaacatagcacaaaattgatgattttaaccattttaaagtgaacagttcaggctgggcgtggtggcttatgcttgtaatcccagtactttgagaggctgaggtgggcagatcacctgaggtcaggagtttgagaccagcctggccaacatgatgaaatccagtctctactaaaaatacaaaaattagccgggcatggtggcaggtgcctgtaatcccagctactcgggaggctgaggcaggagaatcgcttgagcccgggaggtggaggttgcagtgatctgagatcatgccactgcactccaatctgtgtgacagagcaagactctgtcttgaaaaataaataaataaaaaaaattttaaaaagtgaacaattcagggcatttagtatgaggacaatgtggtgcaggtatctctgctactatctacttctagaacactttcttctgccctgaaggaaaccccatgcccaccggcactcacgcccattctcccctctctcccagcctctgtcaaccactaatctactttctgtctctgggggttcacttcttctggacgttttgtgtgactggaatcctgcaatatgtggtccctgcgtgtggcttctttccatagcattgtgttttccagattcacccacacattgtcgcacgttatcagaatctcattcctgactgggtgcagtgggttaggcctgtaatcctaacattctgggaggccaaggcgggacgatcacttgaggcaggagtttgagaccagcctggccagcctagcaagaccccagctaccaaaaaattttaaaagttaactgaacgtggtggtggtgggcacttgtggttcccagctacctgggaggctgaggtgggaggatcgcttaagcccaggaggtcaaggctgcagtgagctatgatcgcaccactgcactccagcctggacaacagagcaagaccctgtctgaaaaaaaaaacaaaaaaaaaagttcctttctttttgtggctggatgacatcccattgtatggccacagcacattttgtttgtctgtttatcgggtggtgggcagtggtttccaccttttgtctcctgtgaataatgctgctgtgaacatttgaattcaagtttttgtttgaacacctgttgtgaattatttggatatatgtgtaggggtaggattgctgagtcctatggtaatgttaggtttgacttactgaggaaccattaaactgttttcaacagtggctgcgccgttctgcatccccaccggcagtgtgtgagggttctgactttacctcctcacaaacgcttcttttccatttaaaaaaatattcagccaggtgctctggctcacgcctgtaatcccagcactttgggaggccgtggcgggcggatcacctgaggtcaggagttcgagacgagcctggccaacatggtgtaaccccatctctaccaaaaatataaaaattagccgggtgtggcagcgggcgcctgtaatcccagctacttgggaggctgaggcaggagaatcacttgaacccgggaggcagaggttgcagtgagccaagatcgcgccactacactccagcctgggtgacaagagtgaaactccatctaaaataaaacaaaaataaaaataaataaaaatttattaaaacattcatcacagccagcctagtgggtgtcccatgtggctttgcctcgcatttccctgataactaggatgctgagcgtcttgtcccaggcttgccacacctcagcactttgagatacgtcgcacagtccccatttgcgaacgagaaatgaggtttagggaacagcagctgtgtcatgtcacacagcgagcagggggtctctgagccgtctgaccccacagccgaccaagctccaatccttaccgcctcctagtgttgtggatgtagcccagggtgctcccacatttttcagatgagaacaccgaagctcaaaacaggagcgttttgtccacattggatacacgatgtctgtggtttggtcctgaagtcactttatatctcagtggtccagactggagtaggacagggggttctggggaatggggaaggtgtctcaggtgaaaggaaggaattccagattctccatactgtccttgggaagttagaagactcagagggtctggcaaagtcagacaaagcaagagaaatgcagtcaggaggaagcggagctgtccaggaacaggggggtcgcaggagctcacccccaggaactacacttgctggggccttcgtgtcacaatgacgtgagcactgcgtgttgattacccactttttttttttttttgaggtggagtctcgctctcttgcccagtctggagtgcagtggcacgatctcggctcactgcaagctctgcctcccgggttcatgccattctcctgcctcagcctcccgcgtagctgggactacaggcgcctgccaccgcgcccggctaatttttgtatttttagtagagatgggatttcactacattagccaggatggtctcgatctcctgacctcatgatccgcccgtctcggcctcccaaagtgctgggattacaggcgtgagccaccgcgcccggcccgatttcccactttaagaatctgtctgtacatcctcaaagccctatacacagtgctgggttgctatagggaatatgaggcttacaggccatggtgctggacacacagaagggacggaggtcaggaggtagaagggcggagagagggaacaggcggaggtcacatccttggctttcaaaatgggccagggagagacaccctctgagcatggtaggacaggaaagcaagattggaacacattgagagcaaccgaggtggctgggcgtggtggcttacgcctgtaatcccaacactttggaaagctgaggtgggtggattgcttgaggccaggagttcaagaccagcctggccaacatggtgagaccccgtctctactaaatatacaaaaattagccaggcgtgatggtgcatacctgtaatcccagctgcttgggaggctgaggcaggagaattgcttaaacctgggaggcggaggttgcagtgagccgagatcccgccactgcactccagcctgggccacagagtgagactccatctcaaaaaaaaaaaaaaaaaaagataaaaagaccaaccgaggaattgaagtgggggggcgtcacagtagcagaagggggatcgtggagcaggccaccctgtggtcatgcactggaagctcattacctgacgatttggagctcatcactgggggcctaaggagaatagatactgaaggatgaggagtgatggcgcggggcacgggtgtctttggtggccagaacttggggactgctggggtgcctcactgcaggccttctcagcgccctttatatgcttacacaggctgtttctaagagggggatacattgcataagcgttttcagactacctcatcatgggtccctttctttaccctctgtggccctggtggcgcactctctgggaaggtgcaggtggatgcccagacccgccctgccatccacctgcacgtccagagctgacttagcctcgagattgctgctggcacctcctgccccgggacacctcggatgtgcccgtggagatgctggctctgtgttttctgctggagtttggtgcgtcttttcctcctgcaagtggccaccgctcttgggtatgtcctcaggcttctgcgagtcatggctgcttctcaggtccttgcccagcgccaggagcaaaccctcctggcactttgttcaggggtggatgcgccagtgttcctgctgtggacccccatctcacatgagggtcttgggcctgcaggctcgttcaggaaacacccgctgagtacgcagtgtgtgccagctgtgtcccaggcaatggcggggacagtggctgctgctggggttgtggtggcttctggggactctggggacagctgaggtgcaaggagccacggctccttgaggatgcagttggactccaggtggaagggatggttgggggaggtataaatggggtcagggaggagacacatttggaacaatgggaacatttttaagatgctatgtcgggaggcaacaaggtggccaacccaggtgctgaggagcccacaccagccctggacgtgttttgccgctcacctttgctggggagtggtgggagagaggattccgttccacgtggtggtgtgcgcagctgggctgtgtggagctgggcgctaggaggaaggtgctttctgcggggctagccgggctctgcctttgaacacaatcaggctccaggttttcagcatccagtgcatgagaggacttcacgggcagctgtggctgatcccttgatgaattgggagaagaacaaaggtctatgaaatgaggtttcatgtagatggcattagagacgcccacaacagatttacagagtggagcggagacggcggatgggtctgggaggcccctcctgctggccttgactgtgacagctgtcctgggaatcagcttccaggccgccccagcagcctgactgacacacacaggggttttagccccatcctgcgaccagctgttgccatcatcagtgacagctgggagtggcggtggttccagccctgggcaccctccccacctgctggggcccacccagggcagtcctgacacctacaggttgcttggagccgcatccgagtcctgccccaccacgtgtgaagcccgagtggtcgtgggctgaggtcccctgattgcatccccacttcccttctgcttcacatagctgcctcttctcaccgtttttccagcctcctgggctaggaattccagtgttgtgctggctttgccccaggacacctccttagccctcttcctgagtctagagccccgggggttggaagttctggcccctgggacacctgcagccacactcagcttctcctgtgagcctccagcatgtcccctcaggaccaagccctcacgttcttgcctccccgcccacctgggctcagccaggggaaggcctggctgggagcgtctcccctctgccctgcccttctcccctctaccctgcccttctctcctctgccccgccatggcttttatatcctgtgccacaagacatggctgtgtgtgaaagtggcagggtctggcatctctgtgggtctctgaggcccacgctccagtgccactcttcccacccgctggccgtgccctcatgctggagggacagcccagccctctcccgaaccccagccccatgtgcccagctgcccccggccctctcccctggaagccggggtcactccagccgtatgccatggtggggacatcctgcttccttggccttccagggaaggtcctctttccaaatggcgacacctggtccctgcctggaggctggaagctgtggcccttgtatgcccctccagggtctgtgcgctcggttggcccgagttcccatcaccgtcatcatcaccatcatcattgtcatttcgcttgtctgtgagccggcctggtctcccagagcagagaccctctgaggtccagcctgagttggggtctccgtgctgacccctgacggggactcaggacgtaccaggtctgggtcaggagtgacccccaaacctcgtgccctttgacaggcacccctgacttttgctaagtgggtggaggtgacatcacttacagcgggagtgatgggacagggtctgttggctgcactgtgctcccagggatctggggagaggctatatccctgggctttggcactgcagagctgtgtgtgtttgtgtgtgtgtgtgtgtgtgtgtgtgtgtgtgtgtgtgtgtgtgtgtgtgtttgcgtgcgcgcacatgtgtataagatctttttttattacatgaagcaagataactgttgctgtttccttttgggttttgtgttcaacagagtggggtacttcttccctcagacaacagaactctcccctttaaacacgtgctgtcagagggtgggtcttgggctcatgtctgtttgcacagccgagtcagaggaaacacagggttcttcataaaaacactgcacagcaggcgactgtccagagtcagcctgcaggacggcagcagccctgcccctcagagcacagctagggtgggctgctttgggatctcccgtcattccctcccagctggcagccggcggccggcccattccttggtgtgctggtcaggggggcgtgcgcctgctctgctcaccctgggaatgggacagaagctggcagctcggagaggacagggctggacccttgggtggcctctggctggaccatctcattgtcctcagacacagcctctcgggtctagtttcatttcctgaaaaacaagtgcacagaactagagcaggagtcgagagctacggcccccgggccagatccagccctgccacctgttttcacaccatgctcaagctgagtgggttttacattttttaattacttgaaaaaaaaaaagccaaaggaggtttcatgacccatgaaaattatatggaattcaaaaaaaaaaaattatatggaattcaaatttcagtgtccataaataatttcttgagacagggtctcgctctgtcacccaggctggagtgcagtgctatggcatggctcgctgtacccttgacctcccaggctcaagcgatcctcctgtctcagcctcctgagtagctgggactacgggtgtgtgccaccaagcccggctaatttttttttaattttagtaaagacagggtctttctatgttgcccaggcttttctggaactccatcttggcctcccaaagtgctgggattacaggctcgagccacggagcccagcctgtttttgttttttcactgataaagttttgccgggtgtggtagtgtgtgcctctagcgatttgggaggctgaggtgggaggatcgcttaagcccaggagtttgaggctgggctcaagtgatcaggaggtgaactatgatcatgtcattgcattccagcctgggtgacagagcaagaacctatctcttaaaaatatatatttaaaaagtattgggtgtggtggctcacgcctgtggtcccagctacttaggcatctgaggtgggaggatggcttgagcccaggagtttgaggttgcagcgagccaagatcgtgtcactacactctagcctgggtgacagagcccagaccctgcctctttaaaaaaaaaaaccaaaaaacatgtattggaacacagccatgcctgttcagtcacgtgctctccatgctgctttctgctccagagacccttatggcctgaaagctgaaaatattttctatcctttacaaaaaagtttgctgacctctgtcctggaaaattcatctcccaagttctcttccggcactggcgttcctgggtgtcctaaatttggcccctgttatttctgaactctgttttggctctgttccctcccaggagccaggacaggcacgttctctgcatcttgtcccctgacgcccagaggcttggctcggctcaggcattcttggaaatatctggctccaggaaaggcagaggcctcctgagtcagcccagagggaacctgccccaggtctgggggaggcctgacccagcagagtggcttttgccgatgggttgggccggtcaagatgtgctgaaagttgtcctcagaaggccactttgggattccttcctccagtattagagcaactgagagctgctcattgcaagcctgatgttttcccagttggccgggtccaccgggtgccctgggattctgggatctgggtggaaagtagggggcttgggggagtgtcctgggttctggaatccaggtggcaagtggtgaggttcagggagtggcttctgagccaccataggggtctctgtgggaggctctgcccatccaggagattccgcaggccctgccggcccagagccagcgtcttgcgcttgccgaggctacagccagccccagccgggtggaacagcccgtcgcctcctctcactttgttttggggccacctgggagtgtggagcaagggtagagagggaggaagtggctgccggccgctgcccagcacccttgtttgccttgggccctctgtgggctcctttttattgctcttcaatgaagccagggaaatggacttccttgcctcacttcagttcaacatgtctggaagtttggtattaaaattaagaaagtgtggaaatagagcaagaagagaaaaatctctccaagagataatagtgacctctgagctgggcgcggtggctcacgcctgtaaatcccagtactttgggaggctgaggcgggcagatcacctgaggtcgggagtttgtgaccggcctgaccaagatggagaaaccccgtctctactaaaaataaataaataaataaataaataaatacaaaattagccaggcatggtggcgcctgcctataatcccagctaaggcaggagaatcgcttgaacctgggaggcaaaggttgcagtgagccaagatcacgccattgcactctagtctgggcaacaagagtgaaactccgtctcaaaaaaaataaataaataaaaaataaaaatagtgacctctggccaggtgtggcagctcatacccgtaatcccagcactttggaaggaaggccgagatgggcagattgctttagcacaggagtttgagaccagcctggccaacatggtggaaccccatctctacaaaaatagaataaaatttaagaggtaatagtgaccttttggtagatcgaaacctggattgctttctttttctaaatgctgattcttttctttgtggtgtttgtgttctgtgccgatgtccctcccccagccctgttattgtgagtggaagaaggggaaagggttcgcccgctactgtgagcccctcctctcacgctgggtgtccttggagaagcctgcacttcttcattgtacgccagggctgggtccctccctggagtggttctgtgctgctgggatggggccaacccctcagatgttttctgagtgtcacacacaggtgtgtgcattcatggcctttgcgtgtcttcctgttgtggaggcaaaaatgtgaagaaccctagatgattttgggaccagggctccatcacctgctgttcattgcacaccggagcatccaggcatgggtggagagctcagacttccaggcacggtcgcaggggctggtctaaccatgttcccgcccgcctgctcgtcagaaccgcctgttgggagctgttatcatgataccatacctgggccctgggctatccgattctgacttaattgctccaggttggggccaggccgttgtttgctgttttgttgtttcttctgtgacgttagccactgggctaatctgagcccctcagttacaggtggagaaactgagacccatgggggtgcaaggacttgccgaggacccagagccccttgggggcagagctgaggcggggcctggctttgggtcccagagcttccagtccccttcccgctctcctaacagcttttttttttgagacaagatctcaccctgtcacccaggctggagtgcaatggcatgatctcggctcactgcaatcttcgctagctgcgttccagcgattctcctgcctcagcctcccgagcagctgggattacaggtgtgtgccgccatgcccagctcgtttttttttgtacttttagtagagatagggtttcaccatgttggccaggctgatctcgaactcctgacctcaaatgatccgcctgcctcggcctcccaaagtgctaggattacaggctgggatcacactgtgcctggccctagcagctttgtcctgtgccatccaacaacagatgaccgaagtctttgtttcttaacatgcattccatctgccttacagttttgccacctgcaaaacagaggacttgtcgcttttctggtaagctggaaatgtaatctggtagcaggaggcctgtggaagcttgcctttaatggccttgtgtctctttcatcctgtcctgagagccggagaacttggatgttgcacctaactcaaccttcctgttaacatacagttctgcaggctcatggatcatcagaaccacgtcctatctcacgcggctgtatgcttccgttggttcaggtgtttttaccttgacagtattttctcctcggtggcttttgcggtggttgcttttaatcagcattgactcttcaagaaaaatatttagctgctacatctcagaggagacagggtggaaagcatctgagacctgcaggctcagacttagaaccagaagtgccctcagagttcatccggccctgacccagcgggaaatgagttcacagagaagcgggagaactttgccccaggccctgccgttgctcataactgccccaggtccttacatttgctccaggtcctgccccaggccctgcagttgctcataactgccccaggtccttatatttgctccaggtcctgccccaggtcctgcagttgctctgtgtggtgggtgtgatctggagccctccgcccattgctgcacctggggcaggcattgctaattgatcccaggactccttcctgcggagcacgccctggttctccaggcagccgctgcctgtcagcctgcagtggttcgggagaggacacctgcttgcctggtctgttccaaatcttgcttctcatcccagcacaggtagggggtgctatgggaaagggatcctcagttggccctgtcactgctctatcagctggggacgtggcatcctagtgaaaacatcatggccgggcgcggtggctcacgcctggaatcccagcactttgggaggctgaggagggtggatcacttgaggtcagaagttcgagaccagcctggtcaacatggtgaaacccatctctactaaaaatacaaaaattcgccaggtgtggtggcgggtacctgtaatccgagctactcgggaggctgaggcaggagaatcgcttgaacctgggaggtggagcttgcagtgagccgagatcttgccactgcactccagcctgggcaacagagtgagacgctgtctcaaaatctcaaacaaacaaacaaacaaaaaacaaacaaacaaagcgtcatttatccagcacccctggggaaccatgctacctggtgttttatggtacctggcaaggtgcaggtgaagttgctgctcttgggcattgaacccgtcttgtttggggcagctcaggccccaggcagggtccgggttggctctcgttggtgtggccctggcccatccagacctatatttctgccgtcctgcaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggtgagtccggggggtcccaagccatggctcagccatgcagacttgcatgaggaggaagtgacgggtccatgcctgggcataagtgttgagctcaggtgccccgacctggggaagggcaggacaggaaaggtgacagtatctggccaaggacagatgggaagggaccaagggagctgattagggagtggttatggactaggaatgtcggtaacaatggttagaaagtgactaacatttgttgagcacctgctgtgtgcccggccctggccgggagccttcgtgcccacagtgaccccgtctgcaaatgtagttccttgccctactcgcactggggagcaggacgcagagccgtgcatctcacaggtgccaagctcaggactccctcctgggtctgcctgggctgggctgtgcttgttgcccctgtggcccacgcatgtgcaccttccacctgaaagccaggatcttcaggacgctccccgaggaggtcgttgtctggcacaatgatttgtctcttcctgaaaaggtgacagagttacactggagagagcagcatccaggtgcggcagggacaggcctggggctcgcgggcagggactctgtgtcctgccggggtcccacactgcacctgcttgtcagaggcactcagtcaatctttgctgatgaaggatgagaggacagaggacgtgatgcttgctgctgcattgcctgcagtcctgggtgagatgcccgggttgactctgctgcccgtcgggtggatgtgatgtcagatccccggctttaaaatacgagggagctgggaattgagggagcaggttggggcagaaagcacagccccgtggaagcctggagctgaggcagtgtgggcgacccctggagcagtgagtgcttccttcatggccttcatcgcaccctgcagtcctcatgtaggggatgccatccatgaatttagttttcccagcctcctttaaaaacgcgttcatgctggggccggggcagtgcagtggctcacatctgaaatcccaccactttgggaggccgaggcgggtggatcatgaggtcaggagatcgagaccatcctggctaacaaggtgaaaccccgtctctactaaaaatacaaaaaattagccgggtgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaagtacaaaaaaaaaaaaattagtctgggtgtggtatcacgcgcctataatctcactactcgagaggctgaggcggagaattgcttgaacccaggaggtagaggttgtagtgagcccgtatcgtaccactgccctccacctgggcaatagagcgagactctgtctcaaaaagaaaaaaaaaaaaagaacatttatgccaggtgtggtggctcatgcctgaaatcccagaactttggaagactgaggcaggaggatcacttgagcccagaaatttgagagtgtcttccctgggcaacatagagagacctcatctctaccagaaaaaaaaaaattagcccggcatggtggcatatccctgtggtcccagctacttagggggctgacgtggcaggatcacctgagtctggaggcagaggttgaagtgagctgagatcatgccactgcactccagcctgggtgacagacagagaccctgtctcaaaaaaaaaaaaaaaaaaaagcatttactatccaccatggaaggtgagactgacctgtgagtgattgttcaaagaacaaaaaataaaccccagagataagacaaaagggtgcctccatgggggtgtgatttaaagctgagaaattgggcttcttccccctcccctctcaccccgtggtttgctaaaggagatgggaaaaaggattctttttttggctgaaatatttaacactaaattaaagccaattttaacagcactttggttgatgagtgaaattaacagactggccaaaaataaacgaacggtctgtactatgtgaaaaagaggcagctttggccatgctgggccaatgtgagttttcagggttgctgggaatgtctgtgaatcggaggaagggcctagctgggactctcaggagccaaggccctgaggggcaacttgcctggtccctgccctgaggcgttcactgctttcttcctgggccagatcacaggcccggaggctggaccactgggctggcactcttgccgagctgctccctgacttcctgaccatgctcctttcagcagccttgctgcactttagtttccttgaatgaaaaatggggatgagaatagctcctacctccaaggtgaatggagtgagttcggacaggtgactccctgggaccagtgcctggcgcctgacaaggtccagtcagagcccgcactgctgttactgatacccttggctgtaccaggggagaacttggttgccattgccaggtgttctcccaccacccccactactgtccctgtttgatgtgtggcgggaataaagctgtgcacattggagcttttggcacatcctggctttcaggtgaaaggtgcgtgtgtgtttgagggtttagcctggccaacccagccatgaggtcggacctgacctgggggtgagtcctgagctcggcacccctgagctgtgtggctcacggcagcattcattgtgtggcttggccgcacccctttccctgctgggctgttgatgtttagactggagcctctgtgttcgcttccaggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaaggtagcgtgggccagaacgtgcacacaggcagcctttatgggaaaaccttgcctctgttcctgcctcaaaggcttcagacacttttcttaaagcactatcgtatttattgtaacgcagttcaagctaatcaaatatgagcaagcctatttaaaaaaaaaaaagatgattataatgagcaagtccggtagacacacataagggcttttgtgaaatgcttgtgtgaatgtgaaatatttgttgtccgttgagcttgacttcagacaccccacccactcccttgtcggtgcccgtttgctcagcagactctttcttcatttatagtgcaaatgtaaacatccaggacaaatacaggaagactttttttttttttttttgagacagagtcttactctgttgcccaggctggagtaccgtagcgtgagctcagctcactgcaacctccgcctcccaggttcaagcgattcttctgcctcagcctcctgagtagctgggactacagacatgcaccaccacacccagctaattttttttatatttttagtagagacagggtttcatcatgttggccaggctggtcttgaactcctgacctcaggtgatctgcccgcctcggcctcccaaagtgctgagataacaggtgtgagccaccgttcccggcataggaaaactttttgccttctaaagaagagtttagcaaactagtctgtgggctggccttctgattctgtaaagaaagtttgattggtggctgggtgcggtggctcacacctgtaatcccatcactttgggaggccgacgtgggcatatcacctgatgtcgggacttcgagaccagcctcaccaacgtggagaaaccccgtctctactaaaaatacaaaaaaaaaattaaccgggcatggcggcgcctgcctgtaatcgcagctactcaggaggctgaagcaggagaattgcttgaacctgggaggcggaggttgtggtgagctgagatggcaccattgcactccagcctgggcaacaaaagtgaaactccgtctcagaaaaaaaaaagtttgattggtgtaaccaaagcgcatttgtttatggattgtctgtggcagcttttgttctgccgagatgagttgtgacagatctgtatgggctctaaagcctaaaacatgtgccatccgcccctttacagaaaaagtgtgctgacctctgttctaaagtattggacaactacaatgtttgctcatttattattctatgatttgttttctgctttttgttgttgttgttgttgttgagatagggtttccctctgtcactcaggctggagtgcagtggtgtaatctcagctcactgcagcctcgacctcctgggctctagtgatcctctcatctcagcctccctagtagctgggactacaggcacacaccaccactcctggctgattttttttttttttttttttttttgtggagacagggtttccgcatgttgcccaggctggtttcaaactcctaggctcaaacacccacctcagcctcccaaagtgctgggattacaggcgtgagccaccatgcccagcctattctactgtttgtattacatagctttaaaagattttttatgactttaagtcacaagggttctttgtagaaaaaaatatatatataggaaagtataaaaagaaagtaaaaattgtccataacctctccagccagagacgaccgttgctgacacctcagcatattgcctttaagtcttttttctctaagatagcatttctcttcatcacagtcatatgctacgcagaattctgtatcctgattttttcacttgacattacaacaggtatttgatggcgctgtgacaaactctttggcacaatcttttaaatgtatgaaatactccactgcacagatgtttgcttttaggcttaactgttcttttattttgcgtgtgctggttacagccgggcacagtggctcatgcctgtaatcacaacactttgagagggtgaggcaggaggatcacttgagcccagaagtttgagaccggcctgggcaacatagtgagaccccatctctacaaaaaacttttttaataagtcgggcgtagtggtgcatagctgtagtcccagccaccaaggaggctgagttgggaggattgcttgagccccaggaggttgatgctgcagtgacctgagattactccactgtactccaacctgagcgacagagcaagacttgtctggggaaaaaaaaaaaaaaaatatatatatatatatatatatatatacatatatacatacacgcacacacacataatataaaaatatatatttataaatatataatatataatataaaaatatatatttataaataaaatttataaattatatttataagtaaatatataatatataatataaaaatatatattatataatatataataaaatatataatataaaaatatatatttataaataatatataatacatacttataagtatatatttaaaatatatgtaatgtatattttttaatgtatgatatataatatacatttataaatacacatttatattattttatataaaatatatataaaatctccaagttgctttttccaaaaaggtgtcttgctgcatttcaaacattcatttaaaaacttgaatgctggtgatctggtccagaatgtgttcagtagctgctgccagtggccaagcatctcgggagatgtctacaaaacacgctggttctggcctggcgtggtggctcacgcctgtaatctcagcactttgggaggctgaggcaggtggatcaactgaggtctggatttcgagaccagccttgccagcttggtgaaaccccatctctactaagaatacaaaaaaattagccaggcgtggtggcatgtgcctgtaatcccacctacttgggaggctaaggctggagaatcgcttgaacccagggggcagaggttgcagtgagccgagatcgcaccattgcactccaggctgggcaagaagagcgaaactccgtctcaaaaaaaaaaaaaaagatgctggttcctaaaatgtggcccttttcctcctcacctgctgccagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaaggggtaagtgtttgcctgtcccgtgcgtccttgtgttcacctcgtatgagacagtgcgggggtgccaactgggcaaggtggcaggctgtccgtgtggccctcagtgattagagctgtactgatgtcattagccttgatggtggccaggactggtagggccctcagaggtcatggagttccttcgtggagcgggtgctgaggctgtatcaggcacagtgctggctgctttcacctgggccgtctcaccgaagtgtccatggagcctgcgtagggtgggtatctgtgtcgattttacagatgcagaaacaggctcagagaaaccgagtgacttccctaaggtcacatacccagttagagcagagctgggccaggaagtgctgtctcaggctcctgaccaggtctccttgctttgcactcttgccaaaaccatgatccagaactgactttgaggtccccggacctcaggctcctccgaaatggcctcttggaggctgctgagccacagcttaggacccacctcgagaggcaaatgtgctttgagctgccaggcgtcctgggggccctgccttgggcacggggttcagacaggccccagatgtgtggggcgtctttctggacttgagttttcttttctgtgtggtggacacagtgctcaccccttaaagcacctgtgatgtgtgcagcagcccaatccctgcctgtcgcctgttctgctagggaaggaaggaagacttcaggatggcaggacaacagaaagaggtccaggttttagagcaagggcaggtcaaacttagaaaattctggaatgaggatgtgcatttcctcttctggatctgctaaaagaagagggaaggaggggctgctgggggaggagcccagagccgagtttacatccggatcccgcaaggcctcccctgccctgaggtcttgttttgtgatgtgcttgtgtccatcctggtttctgccgtgtccccaacatccggccaagcttaggtggatgttccagcacacactcaccctgtctgtgcacctgtttttgtgtccgtaagtgggtatttactcaccttacgagtgagccactgtgggaattcagggaggtggcgcagtgaccacccctggagggatatgtgtgtggcaggggtcgagggtctcgcccttccctgcttcctgcgcgtggctttctccaggacggggagggctgagctgaagaggtggggacagttgcgtccccccgccacccactgtcctgcggtgagagcagactcactgagcctgcccttctcccttgtgccttccagctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtgagggccgggctggggccttctggtcatggagggcggggcagccgggcgttggccacctcccagcctcgccgcacgtaccctgtggcctgcaagttccccaacctggcaggagctgtggccacacccacgactgcccagcagcctcaccctctgctgtgggagttgtccccgtccacccctgggtgcctttgctgcagttatgtcgggagaggctctggtgacagctgtttcctgtgcacctgctgggcactaggtcccagctaatccctgtgccaggactctaatttcaccctaacacacatggtggttttcattgctggggaagctgaggcctgagcacatgacttgccttaggtcacatagctggtgagttcaggatcccccagagataccagggccagcactcgatccccacccagccctgaaccccaccatgtgctgggattgtgctgggagtgtccacacgcctgggaccccagggctggtgctctcatctcctttttccagatcatgagaatgaggctcagggaagtttgaaaaaaacctatcccaagtcacacagcaacaggagcaggatttgaacccagaaaaggggaccgcacactctgttctgctagagtagttagctgtcctgggtgatatggcaggtgacaggggcaactgtgcttaacaaaggaacccccatcccccctgccaagttgggagactagaaggtcaggggcagaagctctgaagggccaggtgcagtggctgacacctctaatcccagcactttgtgaggccaaggcgggcagatgatttgagcccaggagttcaagatcagcctgggtaatgtagtgagacgccatctctacaaaaaaattttttaaaaattagctgggcatggtggttcatgcctgtagtccaagctacttgggaggctcaggtgggaggattgcttgagcccaggaggttgaggttgtggtgagctgtgatcatgccactgcactccagcctgggcaatagagtgagaccgtctccaaaaaaaaaaaaagaagaagaaaaagaagctctgaggctccaagtccccaggcaccccttggcttgagggcagacaagggaggagagggtcacctgggcagccctgacttttgtcccctggcaaagggaccttcagtgaccttggccctaggagagcctctgagcacgtcagccatgtcgaaccgctcaggaagggcagcaagaatttggcttctgacctctgcctctcctactcgccatctgcactgggtgtggttgtgcccattttacagatgaggaggctggggcatcgaccagctgaatgccttgtcccaggtactgcgtaggcagagctggcagttgaaccccgtgtcctggttgtcgctgggggtgggctgcaccctgacttgtgaggccagtagcaaggtttgcacgtgacttcgtgaccgtcacccagctctgcagcacatcccgtgacccagctcatccaggccgcatgcaaacctgttgccaggcgagaaaccagtcaccgcacagctgtggttgcctgaaatgattaagctcattaatcaccccggagtgaggacagactcagatgaaaaccagcaaaagccctggaaactcatgtgaccctgccaatgagggcggccatgtgcattgcagcctggccgtcactcctcggtacgtgttttggacttaaacgctccggatgtttactgagtgcttgattaataacatggaaggcctggtctcattgctgtgggagtgaaggatgcacagccaggcctgacatgatgagaacaagaacctggagtctcgctgcctgggtggtaatcctggccctgccacttagcaactgtgtgactgtagccaggtcacttaattttgctagatcctgcctgcgcttcagtggatcttgctggttttccaaggtggccaaacactttaaggcattcatgtggtcgctaggctgcagggttgaaccctggctcaccccgcagggcgccgtgtgctctgtggcctggctgtgcctttgctgacaccgtgcccgtgtgtgttcatgcaggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagccgtaagtgcctcatggtcccccgcacctcactccctcgttagatcaggctggttctgggagctgacgctgaaaggagcttctcatctggggttcctgggtgtacatagatggttgggtaggttgtgcactgcacaagctgcatgatgctacctgggggtccaggtccaggctggatggacttgttgcttcatcaggacatagataaatggccaaaactcctcagctggaaggtcctgggcaggatctttgggtgtgaaaaccagtcacaggggaagggtgcttgctcatactgccagcacagtgctgagtgctttccatagcgctcgtttactcctcaagcctggagggtggggagtagcatggtcccatttcacgtacaaggaacccgatgcacagagaggtgtggcaacccatccaaggccatacaactggggtgggttgagccggggttgactgtggcaggctggctcaagagtccctgctcctgaacccttgccaggcagcctggcatcagctcggggaatttttgccctgacccttggaagcaagtgggcctctttgttctcatgtcagtgatgagaagagtgactttcctatggcccctctggagtacaggtgtttcctgttggcgggctcttcccccatgacatcagcagcgagctggttatgattccctacgcagaacttgatagtttataaagctctttgtcatccaggccccgttggagtctcacgcagacctggtcgcaggcggggctggtcttgcctgtcccagctgcatggatggggaacttgaggcttgcaaaggttaaggggctgttcgaggcccaggctggcaggagatgggcctgggccagagtctgggacttcccatgcctgggctgtctttggtcctgttgctcaccatccctccctggggccatgaccttagagagccaaatggaggtgcaggtaacccacggcaaggaggggttgccatgactcagagtccccgtcctgtggccggcagtacctggtgcaacgacttggatttcagaccagccactgtagcccgctgacggtgcgctcgaagtgccacagcttctgaagccaggcaggactcaggccaggagactctgttagctgttgagagggagaggccaacggatgttctggttctgctagagagctggttcttcggatcctggtaccagtgcactgagaggaggcccagcttgattctggggctgccttgtggtggcatgtgctgctcactgacaccctcgaggagtgtcttctctcgggcttgttgactgtgcccggttttccgcagttcactggtgcacacataggcacatagcaaaccgcacacacagtcgtgggtatgagtttcactacattccaccaccagtgttcactaccattacctgccttccgtcttaagtgttcatcatttaaaaataaatttattgggctggacgcggtggctcatgactgttatcccagcactttgggaggctgaggcgggcagatcacctgaggtcaggagttcaagaccagcctggccaatatggtgaaactccatctctactaaaaatacaaaattagctgggcatggtggggcatgcctataatcccagctactcaggaggctgaggcaggagaatggcgtgaacccgagaggcagagcttacagtgagcccagatagcaccactgcagtccagcgtgggcaacagtgcgagactccatctcaaaaaaaaaataaataaataaaagaaaaataaatttatgatctatttcaaaaataacacatgtactttgaaacagcagagacacatatgacacggagaatgaaattccccatagcgcacccccaagagacagccctggtccccccgtctttcccgtggacctccagcggggcagatgctgagccgcctgttgtcgagtggcgtgctatcccgtcctccagctcctctgtggcttacagacacccacctgcagccctgtctttgcctcctctagcgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccaggcaggtgccctgtgggaagggtgcggggtgtgcttcccaaggcgctcctcttgctggtttccaggctgctgcccctgtccttagcagagggaggaaacagaggatggctctgggtgaatgatgacttgggcttcgattatgtagtcacagggtatgaccctgagatgcgtggaaccccgagactgtgattatatgtagaaactgggtttccccgttgtttaagtagtcatggtggggtcagaccccacaggacttttgtcttttcaagaaagaaaatggtcgtgtgtcatgcaggggtagttggtactggttaatccaggtttatcctttattttgtgggaactgtacagtcatttctgctacaatgctgtatatgctcttctgaaagacacctatgcaaaatcgcacagtaaaaatgacacaactcatagggaaagcggggccagggcacagccctcaaaatctccatcaatgacatgtaagaaaagagaggaacctgggaaatagcaaagtgccttttgcacattaaatggttagctatatcccacaatactgtgcattcgtaaacgttaatgctgcaataaatacggcacttcaccttgggaagatctggagttggcttatgagtgtggaagggtgtagcgcatgagtttttgtgaaacactggaaggaggattgtgggaaatcaaatggaaagttctcaccccaggcgtggagaagagtgggtcatggccccagcagtgagcccagggaggtcagagacggaggtgtgtgtgtgggtgtgaccctgcgcagttccctgccggctgtagttttttgcattcgcttaatgtttctcgtggaggaaattgtgcatgagcaaatgtgaaaccgtgctgtgctcaaattgtcctaatacatcattgcattggaacagattggcttttttttttttttttttttttttttttttttgagatggagtctcactctgtcaccagcctggagtgcagtggcatgatcttggctcactgcaacctttgcctcctatgttcaagtgattttcctgcctcagcctcctgagtaactgggattacaggcatgagccaccgcggccggccagatttgcatttttgaaacaactgctaggctgggcgcggtggctcacacctgtaatcccagcactgtgggaggccgaggcaggtggatcacctgaggtcaggggttcgagaccagcctggccaacatggtgaaaccccgtctctactgaatatacaaaaatcagctgggtgtggtggcgggtgcctgtaatcccagctactcaggaggctgaggcaggagaattgcttgaacccaggaggcagaggttgcggtgagccgagatcacaccattgcactccagcctgggcaacaagagcaaaactccatctcaaaaaataaaaaatagaaaaacaagtgctgtagcggaagtgagcactttgcggagtcaggcttgtgtggcctgttccacaaatgatgtgctcacggtggcctcaggcccacctggagtctgcagcatggggcacaacaggttcattagtgtagaattccaggacaggcctggctcctaagcagccttcttttacaaaaactgcagagcccgcctgtatcctagcactttgggaggccgaagtgggtggatcacgaggtcaggagttcaagaccagcctggccaacatggtgaaaccccatctctactaaatatacgaaaattagctgggtgtggtggcacgcgcctgtagtcccagctactcgggaggctgaggcagaattgcttgaacctgggaggtggaggttgcagggatctgagaccatgtcattgcactccagcctgggcaacagagcgagacgccatctcaaaaaaaaaaaacctacagagccacacggcctctttctccaccgagtgttggtgtgggagcttgtgttattgtggtgaaatcttggtactttcttgaggcagagagaggctgagcgcctggagagactttcacatgggtcgccatgtccgccgtcggtttcgctgttgtgctccccatctgaaggctggtgccgtccagacaggctggacgcccctttccaccagatccttcctcccgcagcagtttctagttacgttgtactgtgaggtctgtgtccttggttgatggcaaaagtcagccgaattgaaattcagagccatgcctggctccctggagcttctctcctgggcagctgtgatcattgcctctgctgtggtgtgggtggtggaaatggattcctttcatcttgcttgctacaggtgactgtcacgtggagtcctttggagagagggacgtgttaattgatggatgtggctcccatgctgagaaagctcctgggcgtacattgccttagagtttcattggagctgcgttcttttatggtgtctgctaggcagaagtgatgaagacttggaagaaaacccagaaggttttccacttaatttggaaaatgtgcttttcccctcctgtgtcttttgctaaggtccagcctcctgcagcctccccgctctgtggactctggctttgattctttattaggagtccccctgctcccccaaaagatggtgtctaaattatcatccaattggccgaggttttgttttctattaattgtttttattttttattgtggtaaatttatataacataaaatttgccattttaattgttttgttattgttgtttttgagacagggtctcaccccagtgcccaggctggagtgcagtggtgcgatcatggctcactgcagcctcagcctccagggctccagtgatcctctcacctcagcctctctagtagccgggactacaggcatacactaccacatctggctgattttttgtattttttttttattgtagagacccgctatgttgcccaggctggtctcaactcctggactcaagccatcctcccacctcaccctcccaaagtgctgggattacaggcatgagccacaacacccagccattttaatttttttttttttttttgagatggagtctcactctatcgcccaggctggagtgcagtggcgtggtatcaactcactgcaacctctgcctcccaggttcaagcgactctcctgcctcagcctcctcccgagtagctgggattacaggtgcccatcactatgcctggctaatttttgtattttttagcagagacggggtttcaccatgttggccaggctggtcttgaactcctaacctggtgatccgcccgcctcggcctcccaaaatgctgagattacaggtgtgagccaccgtgcccggcctttttttgtttttgagacagggtcttgccctgtcacccagactggagtgcaatggtgggctcttggctcactgcagcctccgcctcccaggctcaagttgtgcacctccacacctggctaactgtattttatgtagagacagatttcaccatgttgcccaggctgggcttgaaatggactcaagcagtccacccacctcagcctcccaaagtgctgagattacaggcgcgagccaccgcacccagcccattttacctattctgcagttgacagttcagtggcattcagtcagttcacgaggtaaccatcactgccattcatctccagactacttcaccttctcggcagatgtccgaaactgtccgcattgaacacactcctcatctccctctgacagccaccattctactttgtatctctctctgccttctctaggtacctcatgtaagtggaattataccaatatttgcccttgtgtgactggcttctttcatgtgacatggtgtcctcaaggttcatctgtgttatagcctgtgtcagaatttccttccttaaagcctgaataataacccgttgtaaaggctgggcgcggtggctcacaccctctaatcccagcattttgggagtccgaggtgggcagatcacttgaggtcaggagtttgagaccagcctggccaacatagtgaaaccctggctctactaaaagtacaaaattagctgggtgtggtggcgcgcacctgtaatcccagttactcaggaggctgaggcaggagaatcgcttgtacccgggaggcagaggttgcagtgaaccaagattgtgcctctgcagtccagcctgggtaacagagtgagacttcctgtctcaaaaaaaaaaaaaatcatcggatggatggacggaccacttcttgttatttatccatccacgggtgctaggtttcttccacctttggttgtcgtgaataaggccactatgaacatttccttccgtggtgaaggttttgtactagtgaggaaaaggcgtgtttgtggtgttgcataggattctggtaagaaagtttgcactaaccataagtatttgtactacattaaaatgaaagctcaggggccgggcgcggtggctcacgcctgtaatcccagcactttgggaggccagggcgggcggatcatgaggtcaggagatcaagaccatcctggccaacatggtgaaaccccgtctctactaaaaataccaaaaaactagccaggtgtggtggcgggcacctgtagtcccagctacttgggaggctgaggcaggagaatggcgtgaacccgggaggcggagcttgcggtgagccgagatcgcttcactgcactcgagcctgggcaacagagcaagactccgtctcacgcaaaactctgtctcacgcaagactccgtctcaaaaaaaaaaagagttcagggtttatgaaactggccagccgcgtaaagtttgctgtgttgtttttgtgcccgggaggagtgtggccagggtgtcacgtcacacagtacacgtttctcagatggtggttctccagactgctgtcccaaagtctgtttttgcatctggttcccacagacccaccctccacggtgagcctgattttggccagggtagctggaatcttgcttgtctttcagcccggcagctgtaccagtccagggtccacagctagtggcttttaggaaggaatttgttcagttggctttgacacatggccccctagggtccacagctctgtagtgatgtggatgttgttatctacaaagacacatgatccttcgtgtccagatgaaagtgatgatgtctttgcagctgcccagcaaggctgtgtgtgtgtgtgtgtgtgtgtgtgtgtgtgtgtgtgtggtgtgtgtgtggtgtgtgtgtgtgtatgggggagggaggcaccctttccatctgggggtgtgtgtgtgtggggtgtgtgtgtgtgtgtgcgcgtgtgtgtggtgtgtggtgtgtgtgtgtgtatgggggaggcaccctttccatctgggtccaagagactgggcctggggaagacgcttctttttatctacttagagactttgttttatttgtatttttttgagacagggtctcactctgtcacccaggctggggtatggtgatatgagcatagctcactgcagcctcggcctcccaggctgaagcgatcctcccacctcagccttctgaatagctgggactgtaggcgtgcgtcaccatactgagctattgttttttttgtttggttggtttaattttttttgatacagatggagtcttgctatgttgcccagactagtctcaaactcctgaactcaagtgattctcccacctcagtttcccgacattctgggatcacaggtgtgagccactgctgtctccctgttttattaactgctgaaagacctagataaagaaagtctgaaaagacttactatcagagcaccatcctaagatgattccctctgactcaatggagagggaggggagcttttccttcaggcctgggtggcaggagcccaggtgctccaggccccatttgccccaggccaaatcactcgggaacttggatgcagctgtctttcagggtaacccaaaggaaccagatccccgcaggcagtaggcttctgggctgtcctctcctcctacgtcagctcagtaagagcccttcgaagggatgctgtgtcggaggccccaaaagcccaggctcatccctgagatgcacagggtgggctgggcttaggcagcgctcgagcatctcctggacggtgaccccagagagtgtggagacggagagtccttgagagtcactgagagacgtggctgccctgccttcccaagaggggctctgagtcattccccacactcacctgcccctacccaccctcacctggcccccagcctcacctacccccacatctgtaccgatccctttacccgcaccttccctacccaccctcacctcccctgtaccttcacctcccccactcacccgcccctgcaccctcacctgtcccccaccttcacctaacccccaccctcacctgccctcccctcacctggcctccttccgttggggaaggggttgtaaggggcggcccccaaactgtctgtcctggtgccctgcagagaaaacagtacgtgagggccgcagtccaaaagcttgagtcctggaaggtggaggagacagggatgtgttgggaagggccccatggtcttggatcccttctcgactgtcaatggggccttcatgggagcgccagtctagtgatgcacagctgggtgcccggcgggtggctgaggaggcctaaagtccgaggcggcaagagctcttccagaggctgttgtcctaatcgctctggcatactcaggcgggcacgtagttaggagctgattggagaggagagacccccacaccaatactgggatttgactttcaggctaaacttgagaagtgtggcctctgctgtcctgccagagctctccagccagtgcccagggctctccagccagtgcccgggggtctccaccagtgcccgggggtctccgccagtgccaggggtctccgccagtgcccaggggtctccgccagtgctcaggagtcttggtttctttgtcttacagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtaggaggccaacgggtgggtgggggtgctgcccgtccaggcgtgcccgccgtgtcttatgccgaatgccagcctctcacaggctggggagactttccacctggggatccaatgggtggctttccagggtcccaaaagcaaacacaggtttttcacagcccgtccgggaaagcagaaagccccaaggggctggaaggggaaagggggagctctgctgagaggttacaaggcagcgctggccgacgggagttgcagttgataggttttgtatcatccttgttaaacttgaaccctgtgcagaaatcccttccacggcatgggggctgcctgttgactcgctcctgttccaccacagggagctcctgggcttcttcctcccagaggcccccgacgctcccacctgttggtcgtcagagcttctggttggtgggaaggcacccaggaccttgaggtctccagagagaaaagccagggaaagagggagaccgaaacccatgtgacatgaaactcaggctccaaactgagcacgggaacgtttggggacaggagcgcgatggccttcctcagatagctggggggctggcatgaagacgggagctacagccagcacaggtcctgggccgggagcccagagattgagccctgactctgtcacttactggccacgtgaccttgggcgggtggcatagcctcttggagactcagtttcctcattggtaggagtgacggccacagtggtgcggcctctgcagcacacggggggctcggtgggcggaagccccgggtctataaggcggctgtgcaggagccagccgagctggtctcccaacagccagggctccggggtccttagcagctgtggggggcctgcacctgtttcccatggctgctgtcagaaattaccagaagccaggtggctgagagtaatggacacttgttctctcacagttcctgagggctgaagcccgagatcgaggtgtgggcagggccctgcgccctctgaaggctctgagggaacctttgggcttctggtggctccaggcaccccttgacttgtggtcctgtcactccagtctctctgtctggctgcacatggcgtggcctcttctgtaccattgaaggacacttcagttggatttagggcctaccctcacccattgtggtcgtatcttgatccttcatgacatttgtaaagaccctgcttccaaataagctcacattctgaggttctggggtgagcgggaatttggagagcattgttcaactagtatagaatgtgacctgtcagcctcgggcagccctgagaggcaggggctttccacagcccagctgggtgccctgggctccgtgctgtccgaggagacgccatccccacacccgtccttcacccgccaccctcccgcaggtacctgtacttcaccaacatgcaggaccgggcagccaagatcgaacgcgcagccctggacggcaccgagcgcgaggtcctcttcaccaccggcctcatccgccctgtggccctggtggtagacaacacactgggcaagctgttctgggtggacgcggacctgaagcgcattgagagctgtgacctgtcaggtacgcgccccggggcctgccctaaccgcagacacccggccttcattgtcagtaatggcagcagctgccacattgtccgagacctgccgtgagcccagtgccgcgccaggggctttgtgtgtagcgtgttttgtcctcacactgacagctgtaggctggggttctgagtgagccccacagggcagaggcagaaaatgagtctcagagagggtgagcgagctgcttggggccccacagcaggagatggagcaggactgcagcctagcctctgcccccagcacctgcgcaagaagctgctctgctctggactgtgttaggctgcgagggctggagagaaatgagagttggtgcttagagagggggcgcaggtccccatggcttttcctcttatgatgaggtagatgggtgaagggaggggccatgcttgcaggggccagtgaccgaggcccgccgttggaactgatggccttcatcccgagcccagcccaggtgggagcagggctttccgagggcttgtcttgggtcggcctgcttccagggactctgctgcagctcccacccctgtccaaagcatggaatcccccaggctccctggcagtcctgtcaacctctgtcctcccaagctgagtgtggggcaagttctggaggtcagcactgctcaggggggcccacgggctgcttgcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctgtacgtgggggctggcagtggggtgggcagggtggcctctaaacccgacccctggaggaggctggaggccagtgcaagatcctgtgtggcctcagccaggcggtggtctctgccagatgccaactgttgcccgctggggttcagcgacatgtccgaatgtcccgaggcctctgaggttgttttcttttgccgcagaacaaatcaccacgaacagcgttttaagacaacaccaactctttttttttttttttttttgagtcaggatcttgctctgttgcccaggctggggtgccctggtgcaaacacagttcactgcagcctcgacctctgggcttaattaagtgaacaccttgcctcagcctcccaggtagctgggactacaggtgggcaccaccacacctggctaatttttttttgtagagacggggtttccccatgttgcccaggctggtctgcaactcctgggcacaagctatctgcctgctgtggcctcccaaagtgctaggattataggtgtgagccactggcctgacaacacccacggattgtctctcagttctgtaaggcaaagtccaggcacagcgtggctcacctgggttctctgctcagggtctcacggggccagaatcaaggtgtcaggaacgctgggccctcagcggaggctctgtggagaaattagcttccttgctcactcagcaggtagcagttgtgggatcgaggttctgttttctctctggttattggtcggggaccactctcagctcctagaggccaccacaggtccttgccccgtggccctctctgcctcagcagtgggggctccctgcgtcagtccctcccacaccttgagtctctctgatttgcttctaaagggccctgtgattcggctcagccacctttagattaggttagcctcccctttgatagactccaagtcggctgattaataaccttaatcacatctgcagaatcccttctgccacataaggtcatgacgccgtgctggggactggggtgggaaattacggggtcatttaggattctgcctgccactgccttgctgtgtcccagggcttgggggaggggcctccacagctgggaccacagtccttcctcccctccatggtaaccatctgaggattacttgagaccagcctgggcaacatggtgagaacccatccctacaaaaaatacaaacaaaaagggaccaggctgggcttggtggctcatgcctataatcccagcactttgggagaccaaggtgggctgatcacttgaggttgggagttcgagaccagcctgcccaacatagtgaaatcccgtctctactaaaaatacaaaaattagctgggtgtggtggcaggcgcctgtattcccagctactggggaggctgaggtgggagaattacttgaacctgggaggcggaagttgcagtgagccaaaattacgccactgcactccagcctaggcaatagagtgagactccgtctcaaaaaaaaaaaagggccaggggtggtagtgacaaagagaccctatcccaaaaaaaccgaacactgaatccttgagactgagtaaggacactgtgaaatttttctgggtggggcagggaacagagcgtcttctgtcatttcttccacctgggtgtggtcagctctccctccaagctgcctcctcttcttctcattgtccgggtgttggacacatttggttaactggatagaataacgcgagttcccagggacttggtccatttgctattttattttattttattttattttattttatttatttatttatttatttatttatttattgagatggagtttcgtttttgtcgcccaggctggagtgcagtggcgcgatctcggttcactgcaacctctgcctcccaggttcaagtgattctcctacctcagccttccaagtaactgggattacaggcacccaccaccataccaggctaatttttttgtatttttagtagagacgggttttcgccattttgcccaggctggtcttcaactcctagcctcaggtgatccacgcacctcggcctcccaaagtgctgggattacaggcatgagccaccacgcctggcaccatttgctattttaattcccatgtgtattagtgtcccacggctgctgtaacaaatgaccacaaactggatggcttaaagcaacagaaatggattcccccaatgtgctggagaccagaagcctgcgaccaaactgttgggagggctgtgcttcctctgggggctccagggaggatctatttgttggcccttccagtgctgtgggtgccagcgttccacacttgtggatgcgccgcctcaacctctgcccatcttcatgtgtccatctcctttgtgtctgcgtctttacctcttcttcttgtctgtgttgcctcttataaggacgtttgtcattgggtttagggcccacccaaatcatccgagatgacctcgtcttgagatccttaacctgcaaagaccctttttccaaaaaaaggttatgctcacagattctaggccttaagacatgggtgtatctttctggggggcactatccaaccccttatacaatgaaagacgggaagagggccaggtgtggtagttcacgcctgtaatctcagcactttaggaagctgaagcgggaggatcacttgagcccaggagtttacaagtagctaggcaacatgatgagaccccatttctacaaaaagtgaaaaaaaaaaaaaaaaaaaaaaagccaggtgtggtggctcacacctgtaatcccagcactttgggaggctgaggcaggcagatcacgaggtcaggagattgagaccatcctggctaacacggtgaaaccccgtctctactaaaaatacaaaaaattatggccgggcgcagtggctcccgcctgtaatcccagcactttgggaggccgaggtgggtgaattacaaggtcaagagatcgagaccatcttggctaacacggtgaaaccccatcaagatcacaaggtcaagagatggagaccatcctggctaacacggtgaaaccccgtctctactaaaaatacaaaaaattagccgggcatggtagcgggcgcctgtagtcccagctgctcgggaggctgaggcaggagaatggcgtgaacccgggaggcggagcttgcggtgagccgagatcgctccatgccactgcactccagcctgggtgacagagtgagactccgtctcaaaaaaaaaaaaaaaaaaaaaaaaaaaagaaaattagccaggcacagtggcaggtgcctattgtcccagctacttgggaggctaaggcaggagaatggcatgaacccgggaggtggagtttgcagtgagccgagatcatgccactgcgctccagcctgggcgatagagcaagactctgtctcaaaaaaaaaagccaggcatggtggtgcatgcctgtagtcccagctactcaagaggctgaggcaggagggttgttcgacccacggagatcaaggctacagtgagccatgatcgcaccactgccctccagcctgggtgacagagtgtgaccctgtctcaaagtaagtaaataggaggagagacaagtgggcagttcagactgatggtatgggcacagtagagactggtgcagacaggctggcctgtgatgtcaagcaacttctgtaattgtttccggcatccatttgtgtgtcaatttccgtgtcagtaggaagactctgtaggctgccaagaggaataagtgggaggatcctcccagagaggccgggcctgcaggagggccagttctcatgagttctcatttggcccctaccctccaggctgtggttctgaggtgggagacagagcctgacctctgtttgtcttgttttgtctttgcagcagcccacccatgtgcccgtgacaatggtggctgctcccacatctgtattgccaagggtgatgggacaccacggtgctcatgcccagtccacctcgtgctcctgcagaacctgctgacctgtggaggtaggtgtgacctaggtgctcctttggggtgatggacaggtacctgattctctgcctgctaggctgctgcctggcatccttttaaaatcacagtccctgtggcatccagtttccaaagctgattgtgtcttcctttgccctcctttcttttctactatgtgcattcggtgctatgaattttcctctaagtactgcgtttcctgcatctcacaaattttgttacattttcattttcaggtagtttgaatatttttacacttctcctgagatgacatctttggctcatgtgttatttagaagtgttgcttagtttctaaagagttggggcttttccagctgtctctctgcaactgatttctaatttaattctactgtagtctgagagcttattttatatgatttctgttattttaaatgtgttgggtgtggtgtttttgttgttattgtttttgtgtctttttgttttgttttgcttcgtttgttttgtttttgagacagtgtcttgctctgtcactcaggctggagtgcaatggcgcgatctcagctcaccgcaacctctgcctcccgggttcaagtgatcctcttgcctcagcctcctgagtagctgggattacaggtgcacgccaccatacccagctaatttttgtatttttagtagagacggggtttcaccatgttggtcaggctggtctcgaactcctgacctcgtgatccgcccacctcggcctcccaaagtgctgggattataggcgtgagccactgtgcctggccattaggtgtgttttatcacccagcatcatgcagtttatcttggtgaatgttctgtgtactcttgaaaagaatgtggattctgctgttgttgggtggagtgttccagaaacatcaattagatccagttggttaatagtgctcatcaggttgtctctatccttccttcctgactgcctgcttgagctgtcagttattgacaggggtgtggagtctccaactctaatggtggatttgtttatttctcctagtagttctatctttttctctccttctacccttgatcctcttctccccctagggcttcctggtgttagtggtgggagagtggggtagtgaagaacctggactttagggccaaagaggccagggttcaaatcctggctctgtcacttcccagttgagtgaccctggctggtgcctgaatctctgtgagcctccacttcctcctctgtgaaattgagagcacttacctggcaggctgtcatgggcatcaagtaacagggcactccacctggaccctgacacgtgatgcacaggaatgccagctgctatgccatgggtgtggcagtagtaataaagtgaccatctgtatcctcaccacagtgaagcctgtccagggctttctctcctatgcccccatgcctccaggtggccttggatcctgttggttctgtgctctgctcagcgacctttctcccgtgggagttcctgggggttcagcttcatcctacagacagcagcacacactggctgtgcaccctttttttttttttttttttttttttgagatggagtctcgcttttttcgcgcaggctgaagtgcagtggtgtgatcttggctcactgcaacctctacctcctgggttcaagtgattttcctgcctcaccctcccaagtagctgggattacaggctcccaccaccacgcccggctaatttttgtattttcagtagagatggtgtttcaccatgttggccaggatggtcttgaactcctgacctcaggtgatccgcccacctcagcctcccaaagtgcagggattacaggcgtgagccaccacacccggagtgccggttgtttttagcagtttgtcttgttcctggagagactggctcctgcccaggagctcggggagtagggccgcggggtgctgcctcacacctcgagtttggccgtaagcagaggggacattttgtgactgtccccctcctgagcttcccagcagcttttctccaagttacagcccaaaagctcaggtggatttgcaacccaacggtgtctgtgcacctcccactgatgcccgaactgccctggccaagaaacggggccgtcagaacgctgcactaactgcagccttgggcctccatgccagaggccatgcccttccatccaccaccccctggcctgggccctgggccctcctggctcgggaactccaggccccttcctcacggctcgagagacgtgtatttaccgcacaggtgcttgtcattctcttgtggcctcttctccagggagatcacagaaggacagggcctcactgaggtctcggacatggaccctttgatagtggcaggagccaggctgggcaagaggcggccacagtcacctcagcagtgccatcaccaccgccattcagcccttccctgagccgggcgcgcccctggctctggccccagtgtcccagttacagctcacaggagcttgtggtgcccagcggctgcttctgattgagagtcgaggtcggaggctttgggaggctgagaggctgctcggtttcacaactgctgagggagacttgggctccatctcaggtatgccccatgtcgccctcaacctccagccaccggtcctccgtgtcccccatggccaggcacggcttgcagacatctgtcgttggctcctctcagccgtcgtgggctgaccctggcacgtcctcctgtggctgagcccagtggggacagctgcttccttttattaccctagaactctcgtctttgatcaggccccctcccctatgccacacagtccctgtcactcgggtgagcccagtagtcatggggaaggcctgcgggttccaaacatccaaaggcttgcgtgcagcatgacagcttgaaaccgatgttttttaccttgatcagatttcagcttggcgggggctttgctcagctttcagtgaggcctgggccgatttcccagcatcccctcctgaggccagcctctgtttcctgtgattttctgcacaaagtgggagggaggagtcctaggaaatggggggccacctcgaagcctaggcctcctctggcttctctgtgccagtgcccccacgctttgtgtctgtgtccccagcccatgggactctgctattccctgagtgctgccgcatgcccagcccgcactgaggacgtggagccccgaggggcaggatggcctccatggtcacacgtaggaagtggcctccaccctccgatgatcctctccctcctccctttcagcgccctccccgggggtgtcctcagccctcctgcctgtgctttgtcccgtcttctgcaggcgcctgggacgtgctgacaggtcctctgccggctcctgccttgctatgcgcacgctggtcaccacagaggcctggcccttcttctgtagcagtcccacacccgcaacaggtgtggctgctgaccacctgctttctgcccctctggtcctgaggagggcgcagtgggcactcaggcgtggctgagcagatgtgtgttgccgggaggaggaaggactgctccagtcagggctgaatttcccacccggagcatttctgctgtatttggtgtagcgcctgctgcttaaagctctgattcccagttggcaccctttcccttctgcattgaaaaacatacggatgcatgtcttcttgcagtgaatgtgtattctcccagcctctcttctgggttggggctggaggtggagcggcacacaggagccgcagcgatggaggatgtgcgggtgcagcaccccgtacagcagggatgccaaacccgcgctgagtccctctcaacttctgctttgaagcccagtcacgccattgcctgggttttgctgggcggggctgcgtgtgatgttctcctctgtccctcccccagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacggtgaggccctccccgtcaaggctctgccaagaccctggccctgccctccgggatacgagcttggggctgcctccggcctcacaggagtaggggctctgaaaacctttgcttgcagggagattgccaagtctgtcttttaggcccaacaaggaaaactctgcagttccacccatcctgtcccaccaggtagtgtggcttgaaggcagactgtgagggtctatctcaccttcctgcattaggtcaggagtttcacagaaacctgaggcacattcaggggtgggctgcagaggtccatggctcacaccctggaaaatccgcccccaaaagacagtgctgtctccactgaccagtctgtgggatagtgcttaagcctgagtggtttctatcaacatgtagaatcaggaggtataaagagatttgctcaggcatcctgggccctctctgaccagcaggatcttcctttagatcttgacagtgaaacacatctcttctgtgccccctgtgagttttctttcattcattcattcattcattcattcattcattcattcattcgagacagagtcttgctctgtcacccaggctggagtgccctggtgtaatctcggctcactgcaacctctgcctccagggttcaatcgattctcctgcctcagcctcccgagtagctgggatgacaggtgcgcaccaccatgcctggctaatttttgtatttttagtagagacagggtttcaccatgttggccaggctggtctcgaactcctgacctcaggtgatccgcccgcctcagcctcccaaagtgctgggattacaggcatgagccaccgcgcccggcctgagttttccttttatgaaggacctgcttggttggttgcctgccacatgttgtcagcaccatgggcccaggactgctgaggagctgttgatgccctcgctctcccagagccaccggctctgttagataattcacatgcagtctggccactgtcctacgtcctcattcacaaagagcagacatttcgtagaagatgagggcctgggagtaacctccctgcatgtttttctataaaggcatagtggttaagtccttccagctcattgaccattggagaattttatggaggctgtagactaggggctggtaaactaagggcccaggggccaaatccagcctgccacctacttttgtaaataaagttttcttggtgcacagccatgcccattcattcatttgcacaatgtctgtggctgctttcatgccaaaagcaagagaactgagtggttatgctggagacctacggccttcaaagccccagacctcacgtctggcccttgacagacagagcttccccagccctgctgcgcatcctggcccagcatgtgctgtgtgtgtgatttcagcttgcaggagccgtggttaggaattgtccctgtgttggtccattttgcattgctatgaaggagcacctgaggccgggtagattatgaaggaaagaggtctgtctggctcatggttctgtaggcagcaccagtatggcacccgcatctgctcagcttctagtgaggtctcaggaagctttgactcatggtgaaagtcgaagcgggagcaggtgcatcacatggtgagagagggagcaacggagagagagagagagcgcctctccctcttgccctcaccttgagaggagatgccaggctcctttaagtaaccagctcccatgtgaactcacagtgagagcccatttgctactgcggagagggcaccaggcatctgctcccatgacccaaacactgcccaccaggccctacctccaaccttggggtcatattttattctgttctatgctatgctatgctatgccatgccatgccatgccatgctattcctattctattatttgagacagaatctcgctctgttgcccaggctggagtgcagtggcatgatcttggctcactgcaacctccacctcccaggttcaagcgattctcctgtatcagcctcccgagtagctgggattacaggcacacaccaccacacccggctaatttttgtattttcaatagagatggggtttcaccatgttggccaggctggtctcaaactcctggcctcaagtgatccacctacctcggcctcccaaagtgccatgattacagatgtgagtcactgcgcccagtgagggtcacatttccgttgagatttggaggggcagacgttggagccatctgagccccctcgtcccgctctagcttctcctcccgtgtgccccgcggtgctggtggcaggcccttacgccggttctggctgcatgctctgttccagaagctttcttccctgcttggttaccagaaaatcatcccatccattacaaggacagggtccccttatctcccattcccagggcaggacaccgggggcagggcaggtggggaactgagcaagttctctgggggcaggcgtggctatggctccctctgggtgggcgtctggggaggggtggaggcagccgtcagcgccctggcttgctcttcctccctggccagagactgtggccttgtgctgctcccgtgtgggctgcctgcacctccagtgggttgtgctccctcccctcccctcccctcaagctctgctgagcaccactgccttccacagcccccactctcgggaggcgaggctcctcgtggccattcctgtccttggcacccacccccccaccaacctggtagagccttgggcggggtctgttactccttgcatggcgtagacctccccacagtaggcacctgacacatacctcctggggggcaggcaggaggtgcgttgaggtctcagccctggcagtccctcccctgcgtggcataggcctcgccacagggtcatcgagggtgggtggagactgtactagaccactccccgctggtcctagaaagggtcccatctgtctgctctctgtttggagtccagaccttggttgctgtgccctgcatggtgggctggggggcaccctccagcctctctgagtgcatggcctctccttgcagccatctgcctgcccaaccagttccggtgtgcgagcggccagtgtgtcctcatcaaacagcagtgcgactccttccccgactgtatcgacggctccgacgagctcatgtgtggtgagccagcttctggcacggggaaggggcgtccgggctgggttcccccaggaacgtggagtttaggggaggagacgtgcctttccagcggggctgggggctgtgtgggagactcaggcggctgggaggctccttgcgggaggcagggaagcctttcccagggcagcggccaggaggacagactgtgagctgtgggctcggcggctacagagtctgcctcagtgggcggggctgatggtgtccaggtgcctgcagcacgcacccacccacgggaccttgctgagcagcgtctgtcaggcagcaagattacccgagggctgcagtggtcctgttccctggcagcttactgtctggctgaggaggagtgatgttcacatatgcacacatgtcatgtgcacacacatgtacatgacaacatcccacatgctcctcaaatagcatgacctgtacagtcacggatatagggcctaggggataggaggccaagacagtcagggaagactttccagaggcagtggctcctgaaaggctgtctgattcaggcaggaagggagctgagttcagataggaagtagcaatgagtcattgtgtctggggacatggccactccttcgctgcagagggacctgggctgagagctcctctcttatggctgcagtcgggagagaagtctgttggggggagaagggggcttcctcaagggactccctgtgccctttggcaccttcgtgccaggtcaggcttgaggcctgaaggcagtggtgggggccaccaagggtcgcctcctctgctgggcaagttcccagtctgacgggcctgtgccgtgggccccagctgtgggggcgctgttgatgcgcagccaggcctcgccgccagagcccgcacgcttccattccgctgacttcatcgacgccctcaggatcgctgggccggccctgtgggagagtgaatgtggcttttgccaaagttgagtctggagcctggaaacttccctatgggcagccttgatagtggagtggcccaaggagcccacccagccgaccctgcccctcccgtggctggtgggcggcaccaggggctgcctggctttgctcgttcaccaacatcacctgggctggccagggcgcgctcacttctgccaccaccgagggccctgggcgaaggagtgaataccaggctgccttggcagggatgtgttgagggctgtggggagtcggacagcggcgggggtcagaggaggaggagggtgcaccgtgcaggctgaagggccacgttaccctgaggttggccaggctccccaggcctagcctcccagctcccccactttctccccaccctccaccagtggcaaagccagccccttcagggcgcacggtgtctgcccccaaggagggcccattccgttggggttaatgttggccacctctttctgtttgtctctggcagaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggtaaggagcctgagatatggaatgatctggaggaggcaggagagtagtctgggcagctttggggagtggagcagggatgtgctaccccaggccctcttgcacatgtggcagacattgctaatcgatcacagcattcagcctttcccactgagcctgtgcttggcatcagaatccttcaacacagaggcctgcatggctgtagcaacccaccctttggcactgtaggtgtggagaaagctccttggacttgaccttcatattctagtaggacatgtgctgtgttgtccacaaatcctcatgtaccctagaaatgaatgtgggggcggctgggctctctccagagctgaaggaatcactctgtaccatacagcagctttgtcttgagtgcagctgggatttgtggctgagcagttacaattcctacgtggcccaggcaccaggaacgcaggctgtgtttgtagatggctgggcagccgcaccgcagagctgcaccatgctggtttgtatcacatgggtgaccatggtatgtctaagaaggtggagtccctgtgaggtctgcaggtgcccccacagctccaggccaccttgaggattgcctctgcctgcccagccctgagttccctctcccctgtcctgtcccactgtcaccccaagccggcctcattgggagcctgttggatggcagggtatagatgtaacctgattctctctggggagcggggttatctggcttctcaagagctcctaggagcccacagtggtggcaccatcacagtcgcagcagcccccagagaacgcggccctgtctgttcctggcgtgctctgtgctgccccgcctgggttccctgccccagtcgcaggccccttggaggaggtaccatgtgtctcccgtttcacagatgagccccggggagctcactctagtagtggccagagaggcctgcggctcagggagcggggcacatttccaacaggacacaccgccctggtctgagtctcgtgggtagtgggagcagaggagagcgccctatgtctgtggggcggcttggctgagcctggaagccacctgacctcccccgtcccttccctgccaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccggtgaggggcggggccggggaggggcggggcgggatggggctgtgggcccctcccaccgtcagtgctggccaccggaggcttcccgggttcctgggggctgtgccaccgcctctgaggcatgcttgctttcttcccttttcaaacccttctgcttccttctttaatgacattgttgattgtggataatctgaaaactacacaaaaatataaagagccaaaatctcacccaaatccacctcctagagtggctgttgggctccgtcagcatccaggcggccgtctgtgttccgcacggcccagcccatcgatagccgcctgcaccaggcctgtctgccctctgtgagcctccccacagggttccctccacaaacaccctgttctcccacccagggctggctgcttcctggaaaacagctggatggttttgtgcatgacagacaaacacagggtgattttcgtggctaaaatactccctggagcttttggcagggtgaggggctggctccagctgagccacgccttgagtgaaatgactgtgaggagaataaactgccgctgccctccaggatcactggggctggctggggagaacccccgtttctgggagcacagtcccaggatgccaaggcgagcttggtgccgagatgtgaactcctgagtgtaaacagcgggggctgacttgacatgctttgtatgcttttcatttgttcctgcagctgtatgcccctaaggtgagtccagcccccttctgcttcctctggggcctcgccagtgagccccaccttgctggggctggttcctcctgcccttctgggtatccctcacatctggggtcttgtcttcttgttttctttttcttttttttttgagacggagtttcacttttgttgcccaggcttcagtgcaatggtgtgatctctaggctcaccgcaacctctgcctcccaggttcaagcagttcccctgcctcagcctccctagtagctgggattacaggcatgtgccaccacgcccagctaattttgtatttttagtagagatggggtttctccatgttggtcaggctgatcttgaactccctacctcaggtgatccgcccaccttggcctcccaaagtgctgggattacaggcgtgagccaccgcacctggcctttttcttttcttttcttttcttttttctgagacagggtctcgctctgtcacccaggctggagtgcaatggtgtcatcatggctaactgcagcctctaccttctaggctcaagcaatcctcccatctcagcccctaagtagctaggactgcacgcatgcatccccatgcccagctaatatttacattttttgtagagatgaagtttcactatattgcccaggctggtctccaactcctggactcgagcgatcctcctgcctcggcctccccaggtgctgggattacaggcgtgagccaccgtgcctggcctggggtattgtcttcttatggcacctgactgtggtgggccctgggaaggaagtagcagaagagggttcttcttggtttcctggacagtaactgagtgttctggaggccccagggcctggctttgtttagggacaaagggaactggtaaccagaagccgagagtttaaacacccactgcccttcttccctgctcctgctgctgcaacccagcttaaccagccaggagtgctaggaacccaagcagggcccccgagcacacagcaggcagctcacgaattctcttttcctgttctcccttgggagctgggaggatcttaatcaggcaataagagatggcactgagcagccagctaattttttaaatcactttattgtttaaccatatgactcacccacttaaaaaagggtacagttcagtgggttttagtgtattcacagatgtgtgcaaccctcaccacagttaattttagaacattttcctgcccctaaaagaaactctgcatgaagccagctgtttttaaattagcaaagttattttgcatcctttaaatatatgttcatggtacaaaattcaaaagatacagaagagtctgcagtccaaagagactccgcccccatgacgccaagcaggcatccctgggaggcatggcctcctgcagtgtgtttcttctatgtccccccaggggtcatctgtacatatgcaagcatacaagagcgtggactttgttttccaagccagaagataattgtagatttatgtgcagttgtgagaaagagcacagacccatttatcctctgcctggtttcccccagtgctgcctgccatcttgcatgacttccattcctatcataagcaagacactgataacgattctttcaccttattcagattgacataagtgttttttgtttgttcttgagacaaacttcctctgtcacccagtgggagtgcagtggcacaatcacagctcactgcagcctcaaactcctgggctcaagcgattctcctgcctcagtcccctcaagtagctcagatggcaggtgtgcaccatcatgccaggctaatttttaaattttttgtggaggtgaggcctcactaaatttcctgggctagtcttgaactcctgagctaaagtgatcctcctgcctcagcctcccaaagtggtaggattacaggcatgagccactgcgcctgggctgacatatgtgttttcgtaagcccgaaagatagcatctgaagagtcaacattgagccttgccttttgctgctaacgatgtataaaagctgctgttctgagcatttcggaggctcccagctgccgtgtgcaccctgcctagagctctaccgtaacccatctccgggaggaggtgctattgttttcctcattttgcaacaaggaggctgaagaactgagcatgaaccactggcctgggtcgttcggttggtaggcagtggggccaggccatccaactcacaaccaccttctactctgcttcccccgcaccctgaagtttgttctgttttgaggacacagccgtcacattcttggtggctgaacagcactccttgtcaggcgtggctgggcccccactggagggcatcatggtcctctctcctgctgcggttgaaccttggctgtttcaaccactcctgccaagtggccctctgaaagggacagtccatcttttctcagcagagggccacactggcaaaacggtccctggcaccctttctctccacctgtctaatatagagtaaaaatggtatcatgttaagatcttcatttatatttattttatcatgaatgatgtaagcatcattttgtgtgtttaagaacctttgggcccagcgtgatggcttgcagctgtaatctcagcactttaggaggctgagatgagcggatcacttgaggccgggagtttgagaccagcctggccaacatggagaaaccccgtctctagtaaaaatttaaaaattagccgggtatggtgatcccagctacttgggagtctgaagcatgagaattgcttgaacatgggaggcggaggttgcagtgagccgagatcgcgccattgcactccagcctgggcgacagagcgagactctgtctcaaaaaaaaaaaaaaaaaagaaaagaaaagaaattatcaatctcctcttttatggcatatatatatatatatatatatatatatatatatatatatattttttttttttggttatgttcagaaaggccttccctgctctgatcataaaaaacaacttattttcacactctctctcttttttttttgagacagagttttgctcctgttgcccaggctggagtgcagtggcgcaatctcagctcactgtaacctccgcctcccgggttggagtgattctcctgccttaccttcccgagtagctgggattataggcatgcaccaccatgcctggctaattttgtacttttagtagagacgggggtttctccatgttggtcaggctggtctcgaactcgcgacctcaggtgatccacccacctcggcctcccaaagtgctgggattacagacgtgagccaccatgcccagcccacactctctttcttaacgtcctcctcctttcgttttacgttcacatctttaattcttctgggatgtaattagatttgatgagcaaggtgggcatccagcttgtttcttggctgatggcttatgggtggcgtgaattagtcggggtctatcaggaggcagaaactctatgagaatttgaacagagaaagttccgtctacaggcttattaccagggactggaatagcagaaattgaacagtgagatgtacagagaactctaagaatgcaggaataggccaggcatggtggctcacacctgtcatcccagcactttgggagaccaaggcgggtggatcacctgaggtcaggagttcgagaccagcctggccaacatagtgaaaccccatctctactaaaaatacaaaaaaattagctgggtgtggtggcgcatgcctgtaatcccagctactcgggaggctgaggcaggagaatcacttgaacctgggaggcagaggttgcagtgagccgagatcatgccactgtactccagcctgggtggaagagcggaactctgtctgaaaaaaaaaaaaaaaacaagaagttcaacttgaagggaaaaatgccgtattgtctttccctttgttatgtcaccagggcacagtccatcccaggctggcgctgatccacgggctggagaggggctgccccagaagaggacatgccaggaagggcttggctggtgttcaggagcccaggccaggtcaggtcaagaggtgttgaggctggacgggagaggccagctaggggctcatgtaggatatgaggggtcggcccatttcaacgtggaaactgagctcttctgcttctctttcttcttcactgcattaagattcaataccgcttgggaagcaggtatttcccttcctataaaggatggttgggagcctgagtgttgggagaaagtgtagccgctgagttactaacaactagggctgccgtcaagcctatggggaaagagagaagaggacatttggaaggagagagatcaagctgtggcaccctgggagaggaccacagaaaagaggccagtgagggggttccccggtggcatctgaaggtgtggcccaaccaggaggtccagaggctgccagccgagtggcccaggagagggaacctcacaggggctgagtgggacccaagccctatccaccgtcctaaccacccacatttctcgggaacaagacctcccacagtggcctccccggcagtggaaatagccaaactggcaacatggactttcttcaactgcccgggcgatgctgcctcagtgccccagggcaggcaggaagctcccacacccattctggaatgaggggttggaggaaggctgagctgagcaaaggacccatctctgctctggttggtggggagggagcccattatacaagagacccctcagggctcagtgaggggtgacagagacttggggagtagtggctgtcactgcagaggtgagagggtttggagagaaggtacatgcctttttggccacattgagtagcacctggtagccagttagtaacgtgtattggataaacaaaagattaaacggatgcaaaaaaaaatgttggctttgcttctttttacccaaacctcagttccctcaagtagattctgggaacaccccctacctggctggactgttgtgaagtttaaataagccaggttaacttcacctcctcctttaagacacagctcagacactgcctcctccaagaagccccctctggcttcctgtgtgaatatgacggccctctgggctctagggtatcttagaacaatgcttccttatggctttggaaccccgctgtctcctggattgggagcaaatgcaggggaggagccacacctgactaatctctgggtctcccagcacataagtggcataagggcagggctgtgcccgcttcaggcacttactgaaggatgtacttggcagagggtaggcagccggcggatgagcccctcactctccccagctgactgcgtgggcgggaaaggcgggttcaggagacccagcctccctgggctgtcaccacctctgcacatccagccccattgatcaagggttcaatttttggggtcctgttgggaggccaggagactctctccaggcacttcttccaggtctttgtgttagggtgtgtgtgtgtgtgtgtgtgtgtgtgtgtgtgtgttgtttgttttattttatttatttatttatttatttatttatttatttatttattttgagacgcagtctcgctctgttgcccaggttggagggtggtggcatgatctcggctcactgcaagctccgcctcccgggttcacgccattctcctgcctcactcttcctgagtagccggattacaggcgcacgcaccatgcctggctaattattttgtttttttagtagagacagggtttcgccacgttgcccaggctggtcttgaatccctggcctcaagcgatccgcccgcctcagcctcccaaagtgctgggattacaggcgtgagccaccgtgcccgcccagcctaggggtacatgaaacttttttttttttttttttgagacagagtttcactctgtcctcaggctggagtgcagtggcgtgatctcggcgtactgcaatctccgcctcccggttcaagcgattctcctgcctcagcctcccgagtagctgggattgcaggcacgcgccaccacacccagctaatttttgtatttttagtagagacgggctttcaccatgtgggacaggatggtctcgatctcctgacctcgtgatccgcccgcctcagcctccgaaagtgctgggattacaggcctgagccaccgtgcccagccatgatgttttgatacaggcatataacgtataataatcacatcagggtaaatgatgtaaccatcacatcaagcatttatcctttgtgttacaaaaaaaaatctaattatactttcctacttattcttttttttttttttttttgagacggagtctccctcagtcgcccaggctggagtgcagtggcatgatctcagttcactgcaagctctgcctcctagctctgcctcctgggttcatgccattctcctgtctcagcctcgcgagtagctgggactacaggcgcctgccaccgtgcccggctaatttttttttttgtatttttggtagagacagggtttcaccgtgttagccaggatggtctcgatctcctgacctcataatccgcccgtctcggcctcccaaagtgctgggattacaggcatgagccaccgcccccagcctatttattcttaaatgtacaataaattattgttgactccagtcaccctgctgtgctaccaaatacggatcttcttcattctatctaactgtatttctgtacctgttaaccatctctcctccacctcaccccccaaacccactacccttctcagcctctggtaaccatccttctactctctatctctatgagttcaattgtattaatttttagctccccggccgggcacggtggctcacgcctgtaatcccagcacttcaggaggctgaggcaggtggatcacgaggtcaggagtttgagaccagcctggccaacatggtggaaccccatctctactaaaaacacaaaaattagctgggcgtggtggtgggcgcttgtagtcccagctacttgggaggctgaggcaggagaatcgcttgaaactgggaggcagaggttgcagtgagccaagattgcgccactgcactccagtctgggtgacagagtaagattccatcccgaaaaaaaaaaagtttagctcccacaaataagtgagaacacgtgaagtttctctttctgtgcctcgcttgtttcacttaacataatgacctccagttccatccacgttgttgctttgttataaatgacaggatcttggtcaggcgcagtggctcatgcctgtaatcccagcactttgggaggctgaggtggactgatcatgaggtcaagagatcgagaccatcctggctaacacagtgaaaccccgtctctactaaaaatacaagaaattagccgggcgtggtggtgggcacccatttccgccccttctcgggacgctgatgcacgacatattacccatccccggaagactaatcctcccccactctatattgtacctcttcctttctcctccacgcgattccccgagtaacccgtcttccctccctcctcggattacgctcacctttccgcttcaatcacgttgctccgtccccttccccattcgtaccactcctcactttcgtcttcctacccccactatcccttttcgtcctctctattccttacttactcctcccccttctcttcatacttcattccctccgctcttcccactcgcgctcccactttcacctagttgccctcacctacgttgccatctcgccccttcttcagctctcggcctctcacccatctgtcctctctcttacctctctcctcatctcgctcagacatctctctagactatccctcactttaccttctcagtcgtcttcttcctatccttcgttctccatgatcttcacgtcgccatctcttttcgcccctttcatatgtctctcttcatgttctcactatcattctcatgatcactatcgttctcactacttatcactcccctctttcttcatcaattcctctccgtcattctcgtctctctcttacaaccgccttccttgtgctatctaactcaaccatgcctctcctactctctctctatcgcccctccatcgcttatgcatcctcttctattgcacacccgcccctccatcgcttatgcatcctcttctattgcacaccgcccctccatcgcttatgcatcctcttctattgcacatcctcttctattgcac

SEQ ID NO: 12 - DNA, 21 bp, Artificial Sequence
  Description of Artificial Sequence: Synthetic oligonucleotide
ctgagcggaattcgtgagacc

SEQ ID NO: 13 - DNA, 23 bp, Artificial Sequence
  Description of Artificial Sequence: Synthetic oligonucleotide
ttggtctcacgtattccgctcga

SEQ ID NO: 14 - DNA, 20 bp, Artificial Sequence
  Description of Artificial Sequence: Synthetic oligonucleotide
ctcgagaattctggatcctc

SEQ ID NO: 15 - DNA, 22 bp, Artificial Sequence
  Description of Artificial Sequence: Synthetic oligonucleotide
ttgaggatccagaattctcgag

SEQ ID NO: 16 - DNA, 21 bp, Artificial Sequence
  Description of Artificial Sequence: Synthetic oligonucleotide
tgtatgcgaattcgctgcgcg

SEQ ID NO: 17 - DNA, 23 bp, Artificial Sequence
  Description of Artificial Sequence: Synthetic oligonucleotide
ttcgcgcagcgaattcgcataca

SEQ ID NO: 18 - DNA, 21 bp, Artificial Sequence
  Description of Artificial Sequence: Synthetic oligonucleotide
gtccactgaattctcagtgag

SEQ ID NO: 19 - DNA, 23 bp, Artificial Sequence
  Description of Artificial Sequence: Synthetic oligonucleotide
ttgtcactgagaattcagtggac

SEQ ID NO: 20 - DNA, 21 bp, Artificial Sequence
  Description of Artificial Sequence: Synthetic oligonucleotide
gaatccgaattcctggtcagc

SEQ ID NO: 21 - DNA, 23 bp, Artificial Sequence
  Description of Artificial Sequence: Synthetic oligonucleotide
ttgctgaccaggaattcggattc

SEQ ID NO: 22 - DNA, 33 bp, Artificial Sequence
  Description of Combined DNA/RNA Molecule: Synthetic primer
  Description of Artificial Sequence: Synthetic primer
cuacuacuacuactgagcggaattcgtgagacc

SEQ ID NO: 23 - DNA, 32 bp, Artificial Sequence
  Description of Combined DNA/RNA Molecule: Synthetic primer
  Description of Artificial Sequence: Synthetic primer
cuacuacuacuactcgagaattctggatcctc

SEQ ID NO: 24 - DNA, 33 bp, Artificial Sequence
  Description of Combined DNA/RNA Molecule: Synthetic primer
  Description of Artificial Sequence: Synthetic primer
cuacuacuacuatgtatgcgaattcgctgcgcg

SEQ ID NO: 25 - DNA, 33 bp, Artificial Sequence
  Description of Combined DNA/RNA Molecule: Synthetic primer
  Description of Artificial Sequence: Synthetic primer
cuacuacuacuagtccactgaattctcagtgag

SEQ ID NO: 26 - DNA, 33 bp, Artificial Sequence
  Description of Combined DNA/RNA Molecule: Synthetic primer
  Description of Artificial Sequence: Synthetic primer
cuacuacuacuagaatccgaattcctggtcagc

SEQ ID NO: 27 - DNA, 45 bp, Artificial Sequence
  Description of Artificial Sequence: Synthetic primer
aactggaagaattcgcggccgcaggaatttttttttttttttttt

SEQ ID NO: 28 - DNA, 13 bp, Artificial Sequence
  Description of Artificial Sequence: Synthetic oligonucleotide
aattcggcacgag

SEQ ID NO: 29 - DNA, 9 bp, Artificial Sequence
  Description of Artificial Sequence: Synthetic oligonucleotide
ctcgtgccg

SEQ ID NO: 30 - DNA, 15 bp, Artificial Sequence
  Description of Artificial Sequence: Synthetic primer
gtaacgacggccagt

SEQ ID NO: 31 - DNA, 16 bp, Artificial Sequence
  Description of Artificial Sequence: Synthetic primer
aacagctatgaccatg

SEQ ID NO: 32 - DNA, 18 bp, Artificial Sequence
  Description of Artificial Sequence: Synthetic primer
ccaagttctgagaagtcc

SEQ ID NO: 33 - DNA, 20 bp, Artificial Sequence
  Description of Artificial Sequence: Synthetic primer
aatacctgaaaccatacctg

SEQ ID NO: 34 - DNA, 57 bp, Artificial Sequence
  Description of Artificial Sequence: Synthetic oligonucleotide
agctgctcgtagctgtctctccctggatcacgggtacatgtactggacagactgggt

SEQ ID NO: 35 - DNA, 56 bp, Artificial Sequence
  Description of Artificial Sequence: Synthetic oligonucleotide
gagacgccccggattgagcgggcagggatagcttattccctgtgccgcattacggc

SEQ ID NO: 36 - DNA, 27 bp, Artificial Sequence
  Description of Artificial Sequence: Synthetic primer
agctgctcgtagctgtctctccctgga

SEQ ID NO: 37 - DNA, 27 bp, Artificial Sequence
  Description of Artificial Sequence: Synthetic primer
gccgtaatgcggcacagggaataagct

SEQ ID NO: 38 - DNA, 20 bp, Artificial Sequence
  Description of Artificial Sequence: Synthetic primer
gagaggctatatccctgggc

SEQ ID NO: 39 - DNA, 20 bp, Artificial Sequence
  Description of Artificial Sequence: Synthetic primer
acagcacgtgtttaaagggg

SEQ ID NO: 40 - DNA, 163 bp, Homo sapiens
actaaagcgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcc

SEQ ID NO: 41 - DNA, 419 bp, Homo sapiens
gccccacagcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtaaaccctgctg

SEQ ID NO: 42 - DNA, 221 bp, Homo sapiens
ccccgtcacaggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggtaggtacccac

SEQ ID NO: 43 - DNA, 221 bp, Homo sapiens
tccctgactgcaggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctatactcacccatggacatccaggtgctgagccaggagcggcagcctttctgtgagtgccgg

SEQ ID NO: 44 - DNA, 156 bp, Homo sapiens
tttctcagtccacactcgctgtgaggaggacaatggcggctgctcccacctgtgcctgctgtccccaagcgagcctttctacacatgcgcctgccccacgggtgtgcagctgcaggacaacggcaggacgtgtaaggcaggtgaggcggtgggacg

SEQ ID NO: 45 - DNA, 416 bp, Homo sapiens
ctccacaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatggggtaagacgggc

SEQ ID NO: 46 - DNA, 198 bp, Homo sapiens
ttcttctccagcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgaggctcctgtgg

SEQ ID NO: 47 - DNA, 244 bp, Homo sapiens
ccgtcctgcaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggtgagtccggggggtc

SEQ ID NO: 48 - DNA, 313 bp, Homo sapiens
gttcgcttccaggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaaggtagcgtgggc

SEQ ID NO: 49 - DNA, 255 bp, Homo sapiens
cctgctgccagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaaggggtaagtgtttgcctgtc

SEQ ID NO: 50 - DNA, 210 bp, Homo sapiens
gtgccttccagctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtgagggccgggct

SEQ ID NO: 51 - DNA, 352 bp, Homo sapiens
gtgttcatgcaggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagccgtaagtgcctcatggt

SEQ ID NO: 52 - DNA, 225 bp, Homo sapiens
gcctcctctacgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccaggcaggtgccctgtgg

SEQ ID NO: 53 - DNA, 235 bp, Homo sapiens
ctttgtcttacagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtaggaggccaac

SEQ ID NO: 54 - DNA, 218 bp, Homo sapiens
ccaccctcccgcaggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggtacgcgccccgg

SEQ ID NO: 55 - DNA, 234 bp, Homo sapiens
ggctgcttgcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctgtacgtgggggc

SEQ ID NO: 56 - DNA, 157 bp, Homo sapiens
ttgtctttgcagcagcccacccatgtgcccgtgacaatggtggctgctcccacatctgtattgccaagggtgatgggacaccacggtgctcatgcccagtccacctcgtgctcctgcagaacctgctgacctgtggaggtaggtgtgacctaggtgc

SEQ ID NO: 57 - DNA, 272 bp, Homo sapiens
gttctcctctgtccctcccccagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggtggactgtgacggtgaggccctcc

SEQ ID NO: 58 - DNA, 134 bp, Homo sapiens
tctccttgcagccatctgcctgcccaaccagttccggtgtgcgagcggccagtgtgtcctcatcaaacagcagtgcgactccttccccgactgtatcgacggctccgacgagctcatgtgtggtgagccagctt

SEQ ID NO: 59 - DNA, 274 bp, Homo sapiens
gtttgtctctggcagaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggtaaggagcctgagatatggaa

SEQ ID NO: 60 - DNA, 164 bp, Homo sapiens
cttccctgccaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccggtgaggggcggg

SEQ ID NO: 61 - DNA, 130 bp, Homo sapiens
ttggctctcctcagatcctgaacccgccgccctccccggccacggacccctccctgtacaacatggacatgttctactcttcaaacattccggccactgcgagaccgtacaggtaggacatcccctgcag

SEQ ID NO: 62 - DNA, 496 bp, Homo sapiens
tcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaaca

SEQ ID NO: 63 - DNA, 22 bp, Artificial Sequence
  Description of Artificial Sequence: Synthetic primer
ttttgggtacacaattcagtcg

SEQ ID NO: 64 - DNA, 21 bp, Artificial Sequence
  Description of Artificial Sequence: Synthetic primer
gtgattgagccaatcctgaga

SEQ ID NO: 65 - DNA, 20 bp, Artificial Sequence
  Description of Artificial Sequence: Synthetic primer
aaaactgtgggtgcttctgg

SEQ ID NO: 66 - DNA, 21 bp, Artificial Sequence
  Description of Artificial Sequence: Synthetic primer
tgagccaaataaaccccttct

SEQ ID NO: 67 - DNA, 20 bp, Artificial Sequence
  Description of Artificial Sequence: Synthetic primer
ctggactacgtggccttctc

SEQ ID NO: 68 - DNA, 19 bp, Artificial Sequence
  Description of Artificial Sequence: Synthetic primer
ttcagaagcacttggctgg

SEQ ID NO: 69 - DNA, 20 bp, Artificial Sequence
  Description of Artificial Sequence: Synthetic primer
ctcagtgccatgaagatgga

SEQ ID NO: 70 - DNA, 21 bp, Artificial Sequence
  Description of Artificial Sequence: Synthetic primer
caagatcactcgatctccagg

SEQ ID NO: 71 - DNA, 20 bp, Artificial Sequence
  Description of Artificial Sequence: Synthetic primer
gtttcaggagactcagagtc

SEQ ID NO: 72 - DNA, 20 bp, Artificial Sequence
  Description of Artificial Sequence: Synthetic primer
ttctgcaggttgctgttgag

SEQ ID NO: 73 - DNA, 20 bp, Artificial Sequence
  Description of Artificial Sequence: Synthetic primer
ttattgtgatttcccgtggc

SEQ ID NO: 74 - DNA, 21 bp, Artificial Sequence
  Description of Artificial Sequence: Synthetic primer
gccctctgtcctgacttcagg

SEQ ID NO: 75 - DNA, 20 bp, Artificial Sequence
  Description of Artificial Sequence: Synthetic primer
gagaaagaaataaggggacc

SEQ ID NO: 76 - DNA, 20 bp, Artificial Sequence
  Description of Artificial Sequence: Synthetic primer
tgctttgtaaagcactgaga

SEQ ID NO: 77 - DNA, 24 bp, Artificial Sequence
  Description of Artificial Sequence: Synthetic primer
gaagtacgggcagttcagtggcct

SEQ ID NO: 78 - DNA, 25 bp, Artificial Sequence
  Description of Artificial Sequence: Synthetic primer
atacaccaaggtccatgttccccgt

SEQ ID NO: 79 - DNA, 27 bp, Artificial Sequence
  Description of Artificial Sequence: Synthetic primer
agcctgggccacagcgtgagactacgt

SEQ ID NO: 80 - DNA, 27 bp, Artificial Sequence
  Description of Artificial Sequence: Synthetic primer
tcccggagcttgcacacccgcttcaca

SEQ ID NO: 81 - DNA, 20 bp, Artificial Sequence
  Description of Artificial Sequence: Synthetic primer
catgtgcccacctcattcat

SEQ ID NO: 82 - DNA, 20 bp, Artificial Sequence
  Description of Artificial Sequence: Synthetic primer
caagattctgtagcttctgg

SEQ ID NO: 83 - DNA, 20 bp, Artificial Sequence
  Description of Artificial Sequence: Synthetic primer
cagagaagtcaagggacttg

SEQ ID NO: 84 - DNA, 20 bp, Artificial Sequence
  Description of Artificial Sequence: Synthetic primer
atcctctcacatcccacact

SEQ ID NO: 85 - DNA, 20 bp, Artificial Sequence
  Description of Artificial Sequence: Synthetic primer
caaggctaaaagacgaaaaa

SEQ ID NO: 86 - DNA, 20 bp, Artificial Sequence
  Description of Artificial Sequence: Synthetic primer
tcaggagcatttcatctttt

SEQ ID NO: 87 - DNA, 19 bp, Artificial Sequence
  Description of Artificial Sequence: Synthetic primer
aagtcgaggctgcaaggag

SEQ ID NO: 88 - DNA, 20 bp, Artificial Sequence
  Description of Artificial Sequence: Synthetic primer
gccctgtgttcctttcagta

SEQ ID NO: 89 - DNA, 19 bp, Artificial Sequence
  Description of Artificial Sequence: Synthetic primer
aaggtgtgaggatcactgg

SEQ ID NO: 90 - DNA, 17 bp, Artificial Sequence
  Description of Artificial Sequence: Synthetic primer
agctcatgggggctatt

SEQ ID NO: 91 - DNA, 20 bp, Artificial Sequence
  Description of Artificial Sequence: Synthetic primer
gcttctccgagtgtatcaac

SEQ ID NO: 92 - DNA, 20 bp, Artificial Sequence
  Description of Artificial Sequence: Synthetic primer
atggcagaggacttagaaca

SEQ ID NO: 93 - DNA, 24 bp, Artificial Sequence
  Description of Artificial Sequence: Synthetic primer
gatcagcgaacttcctctcggctc

SEQ ID NO: 94 - DNA, 24 bp, Artificial Sequence
  Description of Artificial Sequence: Synthetic primer
tccacattgaggactgtgggaacg

SEQ ID NO: 95 - DNA, 20 bp, Artificial Sequence
  Description of Artificial Sequence: Synthetic primer
gctaatcacagtctaaccga

SEQ ID NO: 96 - DNA, 19 bp, Artificial Sequence
  Description of Artificial Sequence: Synthetic primer
ttgcactgtcttggatgca

SEQ ID NO: 97 - DNA, 25 bp, Artificial Sequence
  Description of Artificial Sequence: Synthetic primer
gcacagctgtagtggggttctaggc

SEQ ID NO: 98 - DNA, 25 bp, Artificial Sequence
  Description of Artificial Sequence: Synthetic primer
caggcgcaaaggacatgcacacggc

SEQ ID NO: 99 - DNA, 25 bp, Artificial Sequence
  Description of Artificial Sequence: Synthetic primer
caccgatgagtgcacgttcaaggag

SEQ ID NO: 100 - DNA, 25 bp, Artificial Sequence
  Description of Artificial Sequence: Synthetic primer
cagacagagatgctccacgccatac

SEQ ID NO: 101 - DNA, 19 bp, Artificial Sequence
  Description of Artificial Sequence: Synthetic primer
tttctgggtgtgtctgaat

SEQ ID NO: 102 - DNA, 20 bp, Artificial Sequence
  Description of Artificial Sequence: Synthetic primer
acacagttgctctaaagggt

SEQ ID NO: 103 - DNA, 20 bp, Artificial Sequence
  Description of Artificial Sequence: Synthetic primer
catttgggaaatccagaaga

SEQ ID NO: 104 - DNA, 25 bp, Artificial Sequence
  Description of Artificial Sequence: Synthetic primer
taggtgtcttattttttgttgcttc

SEQ ID NO: 105 - DNA, 25 bp, Artificial Sequence
  Description of Artificial Sequence: Synthetic primer
gacataccatgaacactataagagg

SEQ ID NO: 106 - DNA, 20 bp, Artificial Sequence
  Description of Artificial Sequence: Synthetic primer
caacccataccagggataag

SEQ ID NO: 107 - DNA, 21 bp, Artificial Sequence
  Description of Artificial Sequence: Synthetic primer
gaacaagaggggtaagttggc

SEQ ID NO: 108 - DNA, 22 bp, Artificial Sequence
  Description of Artificial Sequence: Synthetic primer
tgaggacacagatactgatggg

SEQ ID NO: 109 - DNA, 25 bp, Artificial Sequence
  Description of Artificial Sequence: Synthetic primer
gaagtgttccctcttaaattctttg

SEQ ID NO: 110 - DNA, 25 bp, Artificial Sequence
  Description of Artificial Sequence: Synthetic primer
gaactatattgtagttagtgaggag

SEQ ID NO: 111 - DNA, 18 bp, Artificial Sequence
  Description of Artificial Sequence: Synthetic primer
cctgtaacccccagtccc

SEQ ID NO: 112 - DNA, 22 bp, Artificial Sequence
  Description of Artificial Sequence: Synthetic primer
tcttgcttcctaagtttctcgg

SEQ ID NO: 113 - DNA, 21 bp, Artificial Sequence
  Description of Artificial Sequence: Synthetic primer
actccatccacctcatcactg

SEQ ID NO: 114 - DNA, 20 bp, Artificial Sequence
  Description of Artificial Sequence: Synthetic primer
tgctgtttgcctcatctgac

SEQ ID NO: 115 - DNA, 20 bp, Artificial Sequence
  Description of Artificial Sequence: Synthetic primer
gtggacaggcatagctgagg

SEQ ID NO: 116 - DNA, 21 bp, Artificial Sequence
  Description of Artificial Sequence: Synthetic primer
tgttcactcttctgcctgcag

SEQ ID NO: 117 - DNA, 20 bp, Artificial Sequence
  Description of Artificial Sequence: Synthetic primer
agctggactctcacagaatg

SEQ ID NO: 118 - DNA, 20 bp, Artificial Sequence
  Description of Artificial Sequence: Synthetic primer
caagaggctggtagaaggtg

SEQ ID NO: 119 - DNA, 24 bp, Artificial Sequence
  Description of Artificial Sequence: Synthetic primer
gactccagtctgggcaataaaagc

SEQ ID NO: 120 - DNA, 22 bp, Artificial Sequence
  Description of Artificial Sequence: Synthetic primer
ggtggcagcatgacctctaaag

SEQ ID NO: 121 - DNA, 16 bp, Artificial Sequence
  Description of Artificial Sequence: Synthetic primer
caggcccagtctcttg

SEQ ID NO: 122 - DNA, 18 bp, Artificial Sequence
  Description of Artificial Sequence: Synthetic primer
cgtgtccagatgaaagtg

SEQ ID NO: 123 - DNA, 18 bp, Artificial Sequence
  Description of Artificial Sequence: Synthetic primer
acctcacggtgtaatccc

SEQ ID NO: 124 - DNA, 18 bp, Artificial Sequence
  Description of Artificial Sequence: Synthetic primer
cttgaagcccatctttgc

SEQ ID NO: 125 - DNA, 23 bp, Artificial Sequence
  Description of Artificial Sequence: Synthetic primer
tatttgcaaagcttgagacttct

SEQ ID NO: 126 - DNA, 20 bp, Artificial Sequence
  Description of Artificial Sequence: Synthetic primer
aatcactgtgctttgttgcc

SEQ ID NO: 127 - DNA, 20 bp, Artificial Sequence
  Description of Artificial Sequence: Synthetic primer
actttattgtcagcgtgggc

SEQ ID NO: 128 - DNA, 18 bp, Artificial Sequence
  Description of Artificial Sequence: Synthetic primer
actccctcgatggcttcc

SEQ ID NO: 129 - DNA, 18 bp, Artificial Sequence
  Description of Artificial Sequence: Synthetic primer
gagcaggggagagaaggc

SEQ ID NO: 130 - DNA, 21 bp, Artificial Sequence
  Description of Artificial Sequence: Synthetic primer
cccaactggcttgttttattg

SEQ ID NO: 131 - DNA, 25 bp, Artificial Sequence
  Description of Artificial Sequence: Synthetic primer
agccactttattgttattttgatgc

SEQ ID NO: 132 - DNA, 25 bp, Artificial Sequence
  Description of Artificial Sequence: Synthetic primer
aagagtgaacaaaagcaaacatacc

SEQ ID NO: 133 - DNA, 18 bp, Artificial Sequence
  Description of Artificial Sequence: Synthetic primer
gtggagtgtgggattggg

SEQ ID NO: 134 - DNA, 25 bp, Artificial Sequence
  Description of Artificial Sequence: Synthetic primer
tactgttcttgataagtatgtcggc

SEQ ID NO: 135 - DNA, 25 bp, Artificial Sequence
  Description of Artificial Sequence: Synthetic primer
atgcttttgcatgattctaattatt

SEQ ID NO: 136 - DNA, 21 bp, Artificial Sequence
  Description of Artificial Sequence: Synthetic primer
tcccccaaaagaatgtaaagg

SEQ ID NO: 137 - DNA, 20 bp, Artificial Sequence
  Description of Artificial Sequence: Synthetic primer
ctggtcttccttgtgtgctg

SEQ ID NO: 138 - DNA, 18 bp, Artificial Sequence
  Description of Artificial Sequence: Synthetic primer
atcacccaggccagggat

SEQ ID NO: 139 - DNA, 24 bp, Artificial Sequence
  Description of Artificial Sequence: Synthetic primer
tcagaagcagaactgtttttaaca

SEQ ID NO: 140 - DNA, 22 bp, Artificial Sequence
  Description of Artificial Sequence: Synthetic primer
cctgcttgaaagttctagagcc

SEQ ID NO: 141 - DNA, 20 bp, Artificial Sequence
  Description of Artificial Sequence: Synthetic primer
caagccgggttttattgaaa

SEQ ID NO: 142 - DNA, 18 bp, Artificial Sequence
  Description of Artificial Sequence: Synthetic primer
gatgccaggaccatggac

SEQ ID NO: 143 - DNA, 24 bp, Artificial Sequence
  Description of Artificial Sequence: Synthetic primer
gcatatagaaacaatttattgccg

SEQ ID NO: 144 - DNA, 20 bp, Artificial Sequence
  Description of Artificial Sequence: Synthetic primer
ctctgaagcagggaccagag

SEQ ID NO: 145 - DNA, 19 bp, Artificial Sequence
  Description of Artificial Sequence: Synthetic primer
ctaccacaccacaccaggc

SEQ ID NO: 146 - DNA, 18 bp, Artificial Sequence
  Description of Artificial Sequence: Synthetic primer
caagcgaaagctgccttc

SEQ ID NO: 147 - DNA, 23 bp, Artificial Sequence
  Description of Artificial Sequence: Synthetic primer
gttgtcttgacttcaggtctgtc

SEQ ID NO: 148 - DNA, 24 bp, Artificial Sequence
  Description of Artificial Sequence: Synthetic primer
ttttccttcaacaatcactactcc

SEQ ID NO: 149 - DNA, 20 bp, Artificial Sequence
  Description of Artificial Sequence: Synthetic primer
gcgtggggatatagaggtca

SEQ ID NO: 150 - DNA, 20 bp, Artificial Sequence
  Description of Artificial Sequence: Synthetic primer
tacgtggccaagaagctagg

SEQ ID NO: 151 - DNA, 24 bp, Artificial Sequence
  Description of Artificial Sequence: Synthetic primer
taatatatccccagtctaaggcat

SEQ ID NO: 152 - DNA, 18 bp, Artificial Sequence
  Description of Artificial Sequence: Synthetic primer
agcttgcagatggagccc

SEQ ID NO: 153 - DNA, 25 bp, Artificial Sequence
  Description of Artificial Sequence: Synthetic primer
tggttttaaacctttaatgagaaaa

SEQ ID NO: 154 - DNA, 23 bp, Artificial Sequence
  Description of Artificial Sequence: Synthetic primer
tgttgatctataccctgtttccg

SEQ ID NO: 155 - DNA, 25 bp, Artificial Sequence
  Description of Artificial Sequence: Synthetic primer
aattatttaaaagagaggaaaggca

SEQ ID NO: 156 - DNA, 20 bp, Artificial Sequence
  Description of Artificial Sequence: Synthetic primer
tggctgtgaacttcctctga

SEQ ID NO: 157 - DNA, 25 bp, Artificial Sequence
  Description of Artificial Sequence: Synthetic primer
ggttacagaaaaacatttgagagat

SEQ ID NO: 158 - DNA, 22 bp, Artificial Sequence
  Description of Artificial Sequence: Synthetic primer
tgagctttagttcccttctctg

SEQ ID NO: 159 - DNA, 23 bp, Artificial Sequence
  Description of Artificial Sequence: Synthetic primer
ttgaaaaaccatttatttcaccg

SEQ ID NO: 160 - DNA, 18 bp, Artificial Sequence
  Description of Artificial Sequence: Synthetic primer
tctgcggctgttggattt

SEQ ID NO: 161 - DNA, 23 bp, Artificial Sequence
  Description of Artificial Sequence: Synthetic primer
ttgaaaaaccatttatttcaccg

SEQ ID NO: 162 - DNA, 20 bp, Artificial Sequence
  Description of Artificial Sequence: Synthetic primer
tgttctcttctcccagcagg

SEQ ID NO: 163 - DNA, 23 bp, Artificial Sequence
  Description of Artificial Sequence: Synthetic primer
ctttattgaaaacattgagtgca

SEQ ID NO: 164 - DNA, 20 bp, Artificial Sequence
  Description of Artificial Sequence: Synthetic primer
ttgtcaaattccccccaaaa

SEQ ID NO: 165 - DNA, 16 bp, Artificial Sequence
  Description of Artificial Sequence: Synthetic primer
  modified_base (12)..(12): a, c, g, t, unknown or other
aaaccacgaccnccaa

SEQ ID NO: 166 - DNA, 20 bp, Artificial Sequence
  Description of Artificial Sequence: Synthetic primer
ccctggaaaggtaagatgct

SEQ ID NO: 167 - DNA, 23 bp, Artificial Sequence
  Description of Artificial Sequence: Synthetic primer
cttttggtagagacaaggtctca

SEQ ID NO: 168 - DNA, 25 bp, Artificial Sequence
  Description of Artificial Sequence: Synthetic primer
tatctgtctgtagtgcttcaaatgt

SEQ ID NO: 169 - DNA, 19 bp, Artificial Sequence
  Description of Artificial Sequence: Synthetic primer
gacgaaggtgattcagggc

SEQ ID NO: 170 - DNA, 19 bp, Artificial Sequence
  Description of Artificial Sequence: Synthetic primer
actgaagaactcttgtcct

SEQ ID NO: 171 - DNA, 25 bp, Artificial Sequence
  Description of Artificial Sequence: Synthetic primer
cagataaaagagtcactatggctca

SEQ ID NO: 172 - DNA, 20 bp, Artificial Sequence
  Description of Artificial Sequence: Synthetic primer
cacttctcccactttgtccc

SEQ ID NO: 173 - DNA, 25 bp, Artificial Sequence
  Description of Artificial Sequence: Synthetic primer
ttattgataagcattagtgaacccc

SEQ ID NO: 174 - DNA, 20 bp, Artificial Sequence
  Description of Artificial Sequence: Synthetic primer
tggcaagttaggcacagtca

SEQ ID NO: 175 - DNA, 21 bp, Artificial Sequence
  Description of Artificial Sequence: Synthetic primer
ctatgcccagagatgaacagg

SEQ ID NO: 176 - DNA, 20 bp, Artificial Sequence
  Description of Artificial Sequence: Synthetic primer
tccactaagggctatgtcgc

SEQ ID NO: 177 - DNA, 24 bp, Artificial Sequence
  Description of Artificial Sequence: Synthetic primer
gccagctttattgagtaaacttcc

SEQ ID NO: 178 - DNA, 22 bp, Artificial Sequence
  Description of Artificial Sequence: Synthetic primer
cactggagactacaagtggtgg

SEQ ID NO: 179 - DNA, 20 bp, Artificial Sequence
  Description of Artificial Sequence: Synthetic primer
catcccaaccatcactcagt

SEQ ID NO: 180 - DNA, 22 bp, Artificial Sequence
  Description of Artificial Sequence: Synthetic primer
ggggactagcttacagatttga

SEQ ID NO: 181 - DNA, 23 bp, Artificial Sequence
  Description of Artificial Sequence: Synthetic primer
agactacattttggaaccagtgg

SEQ ID NO: 182 - DNA, 23 bp, Artificial Sequence
  Description of Artificial Sequence: Synthetic primer
tgaaaggatatttatagcctgga

SEQ ID NO: 183 - DNA, 20 bp, Artificial Sequence
  Description of Artificial Sequence: Synthetic primer
gaaggttttgtccctcgatc

SEQ ID NO: 184 - DNA, 20 bp, Artificial Sequence
  Description of Artificial Sequence: Synthetic primer
tgagggttgggaagatcata

SEQ ID NO: 185 - DNA, 18 bp, Artificial Sequence
  Description of Artificial Sequence: Synthetic primer
ccttcatagccacacccg

SEQ ID NO: 186 - DNA, 21 bp, Artificial Sequence
  Description of Artificial Sequence: Synthetic primer
cagctaactgttgacatgcca

SEQ ID NO: 187 - DNA, 25 bp, Artificial Sequence
  Description of Artificial Sequence: Synthetic primer
tctttactgtgcttacaactttcct

SEQ ID NO: 188 - DNA, 20 bp, Artificial Sequence
  Description of Artificial Sequence: Synthetic primer
caacagtgcagtcggtatcg

SEQ ID NO: 189 - DNA, 18 bp, Artificial Sequence
  Description of Artificial Sequence: Synthetic primer
agatcagcaagcagatag

SEQ ID NO: 190 - DNA, 18 bp, Artificial Sequence
  Description of Artificial Sequence: Synthetic primer
cattccacatggatagac

SEQ ID NO: 191 - DNA, 24 bp, Artificial Sequence
  Description of Artificial Sequence: Synthetic primer
catacctatgaggtgtgctacagg

SEQ ID NO: 192 - DNA, 21 bp, Artificial Sequence
  Description of Artificial Sequence: Synthetic primer
gcattttctcatcatccttgc

SEQ ID NO: 193 - DNA, 20 bp, Artificial Sequence
  Description of Artificial Sequence: Synthetic primer
ttacagccaccaaggtttcc

SEQ ID NO: 194 - DNA, 20 bp, Artificial Sequence
  Description of Artificial Sequence: Synthetic primer
aggtgtgtgtgccaggttga

SEQ ID NO: 195 - DNA, 25 bp, Artificial Sequence
  Description of Artificial Sequence: Synthetic primer
cactgttatctcattaactgtgagg

SEQ ID NO: 196 - DNA, 21 bp, Artificial Sequence
  Description of Artificial Sequence: Synthetic primer
tttgattttgtgtctcccaaa

SEQ ID NO: 197 - DNA, 20 bp, Artificial Sequence
  Description of Artificial Sequence: Synthetic primer
ccccactcccacttttattt

SEQ ID NO: 198 - DNA, 24 bp, Artificial Sequence
  Description of Artificial Sequence: Synthetic primer
ccagtcacctttactagtcctttg

SEQ ID NO: 199 - DNA, 20 bp, Artificial Sequence
  Description of Artificial Sequence: Synthetic primer
aggacacagcctgcatctag

SEQ ID NO: 200 - DNA, 20 bp, Artificial Sequence
  Description of Artificial Sequence: Synthetic primer
accaggcattgcactaaaag

SEQ ID NO: 201 - DNA, 22 bp, Artificial Sequence
  Description of Artificial Sequence: Synthetic primer
gatgggtcacactaacctgtca

SEQ ID NO: 202 - DNA, 24 bp, Artificial Sequence
  Description of Artificial Sequence: Synthetic primer
acatttatatttggacatgcaacc

SEQ ID NO: 203 - DNA, 22 bp, Artificial Sequence
  Description of Artificial Sequence: Synthetic primer
agcatctttaatgtgtcaggca

SEQ ID NO: 204 - DNA, 18 bp, Artificial Sequence
  Description of Artificial Sequence: Synthetic primer
atgtgctgggctggaaag

SEQ ID NO: 205 - DNA, 20 bp, Artificial Sequence
  Description of Artificial Sequence: Synthetic primer
tcacattcaaaaatcggcaa

SEQ ID NO: 206 - DNA, 18 bp, Artificial Sequence
  Description of Artificial Sequence: Synthetic primer
ctgcctgtgtggtgtcgc

SEQ ID NO: 207 - DNA, 25 bp, Artificial Sequence
  Description of Artificial Sequence: Synthetic primer
tgttttatttctcagtacaaagcca

SEQ ID NO: 208 - DNA, 19 bp, Artificial Sequence
  Description of Artificial Sequence: Synthetic primer
gacctcctgtgacaccacg

SEQ ID NO: 209 - DNA, 25 bp, Artificial Sequence
  Description of Artificial Sequence: Synthetic primer
ccaccaaattatttatagttctgcg

SEQ ID NO: 210 - DNA, 23 bp, Artificial Sequence
  Description of Artificial Sequence: Synthetic primer
gtaagattctccactgttgcacc

SEQ ID NO: 211 - DNA, 20 bp, Artificial Sequence
  Description of Artificial Sequence: Synthetic primer
cctataatgggctggaccaa

SEQ ID NO: 212 - DNA, 21 bp, Artificial Sequence
  Description of Artificial Sequence: Synthetic primer
actcctcatgtgaagtcaccg

SEQ ID NO: 213 - DNA, 20 bp, Artificial Sequence
  Description of Artificial Sequence: Synthetic primer
cagtgtgcacgttttcattt

SEQ ID NO: 214 - DNA, 20 bp, Artificial Sequence
  Description of Artificial Sequence: Synthetic primer
cagcatcttcagcacttacc

SEQ ID NO: 215 - DNA, 25 bp, Artificial Sequence
  Description of Artificial Sequence: Synthetic primer
ctgcatttattatgagaatcaacag

SEQ ID NO: 216 - DNA, 20 bp, Artificial Sequence
  Description of Artificial Sequence: Synthetic primer
tgctgctgggagtcagagtc

SEQ ID NO: 217 - DNA, 23 bp, Artificial Sequence
  Description of Artificial Sequence: Synthetic primer
cagggcactgagatacacttacc

SEQ ID NO: 218 - DNA, 20 bp, Artificial Sequence
  Description of Artificial Sequence: Synthetic primer
aaggatcaagcaggcatttg

SEQ ID NO: 219 - DNA, 20 bp, Artificial Sequence
  Description of Artificial Sequence: Synthetic primer
acacatctcttctgtgcccc

SEQ ID NO: 220 - DNA, 18 bp, Artificial Sequence
  Description of Artificial Sequence: Synthetic primer
tgaaccctggaggcagag

SEQ ID NO: 221 - DNA, 19 bp, Artificial Sequence
  Description of Artificial Sequence: Synthetic primer
cattccccagtttgcagac

SEQ ID NO: 222 - DNA, 19 bp, Artificial Sequence
  Description of Artificial Sequence: Synthetic primer
gtgctgggattacaggtgt

SEQ ID NO: 223 - DNA, 20 bp, Artificial Sequence
  Description of Artificial Sequence: Synthetic primer
gcagagaagtcctgttagcc

SEQ ID NO: 224 - DNA, 20 bp, Artificial Sequence
  Description of Artificial Sequence: Synthetic primer
ccatgctagagaagcacaac

SEQ ID NO: 225 - DNA, 20 bp, Artificial Sequence
  Description of Artificial Sequence: Synthetic primer
agtgtggggcaggacctctg

SEQ ID NO: 226 - DNA, 21 bp, Artificial Sequence
  Description of Artificial Sequence: Synthetic primer
cagacagatagccctgggttc

SEQ ID NO: 227 - DNA, 20 bp, Artificial Sequence
  Description of Artificial Sequence: Synthetic primer
tccctcatccccttgtctgt

SEQ ID NO: 228 - DNA, 19 bp, Artificial Sequence
  Description of Artificial Sequence: Synthetic primer
agcccccctggggataatc

SEQ ID NO: 229 - DNA, 19 bp, Artificial Sequence
  Description of Artificial Sequence: Synthetic primer
gatgcttacctaccacggc

SEQ ID NO: 230 - DNA, 21 bp, Artificial Sequence
  Description of Artificial Sequence: Synthetic primer
aggattcctatctgggctatg

SEQ ID NO: 231 - DNA, 20 bp, Artificial Sequence
  Description of Artificial Sequence: Synthetic primer
tggcagaccatgctccgcct

SEQ ID NO: 232 - DNA, 20 bp, Artificial Sequence
  Description of Artificial Sequence: Synthetic primer
gagaaggccgggaggctctg

SEQ ID NO: 233 - DNA, 25 bp, Artificial Sequence
  Description of Artificial Sequence: Synthetic primer
ctccatcacaaccagatttgaggct

SEQ ID NO: 234 - DNA, 22 bp, Artificial Sequence
  Description of Artificial Sequence: Synthetic primer
gggtgtgagctgctgctgaagg

SEQ ID NO: 235 - DNA, 26 bp, Artificial Sequence
  Description of Artificial Sequence: Synthetic primer
agtgggaaacctcaggtagctcccga

SEQ ID NO: 236 - DNA, 26 bp, Artificial Sequence
  Description of Artificial Sequence: Synthetic primer
cagtttggctcagacatatgggggca

SEQ ID NO: 237 - DNA, 21 bp, Artificial Sequence
  Description of Artificial Sequence: Synthetic primer
cattaagtagtggggggacag

SEQ ID NO: 238 - DNA, 21 bp, Artificial Sequence
  Description of Artificial Sequence: Synthetic primer
caaagcgacagtgagttaggg

SEQ ID NO: 239 - DNA, 20 bp, Artificial Sequence
  Description of Artificial Sequence: Synthetic primer
ggagtagaccatgattactg

SEQ ID NO: 240 - DNA, 19 bp, Artificial Sequence
  Description of Artificial Sequence: Synthetic primer
catggtctatttattctcg

SEQ ID NO: 241 - DNA, 22 bp, Artificial Sequence
  Description of Artificial Sequence: Synthetic primer
cgccctggatcctcacactaca

SEQ ID NO: 242 - DNA, 21 bp, Artificial Sequence
  Description of Artificial Sequence: Synthetic primer
gggcatcaggggatgggtaga

SEQ ID NO: 243 - DNA, 23 bp, Artificial Sequence
  Description of Artificial Sequence: Synthetic primer
gctcctatctgtgttttgaatgg

SEQ ID NO: 244 - DNA, 23 bp, Artificial Sequence
  Description of Artificial Sequence: Synthetic primer
ccgtggcataagataagtaaacg

SEQ ID NO: 245 - DNA, 22 bp, Artificial Sequence
  Description of Artificial Sequence: Synthetic primer
cttggagcgctatgaggagggc

SEQ ID NO: 246 - DNA, 23 bp, Artificial Sequence
  Description of Artificial Sequence: Synthetic primer
atggcaactgaccttccgtcctg

SEQ ID NO: 247 - DNA, 16 bp, Artificial Sequence
  Description of Artificial Sequence: Synthetic primer
ttggagtcacaggggc

SEQ ID NO: 248 - DNA, 17 bp, Artificial Sequence
  Description of Artificial Sequence: Synthetic primer
cagcactatccttgggg

SEQ ID NO: 249 - DNA, 21 bp, Artificial Sequence
  Description of Artificial Sequence: Synthetic primer
aacaaagctgcttagcacctg

SEQ ID NO: 250 - DNA, 20 bp, Artificial Sequence
  Description of Artificial Sequence: Synthetic primer
gatgaggaccaactggtgac

SEQ ID NO: 251 - DNA, 20 bp, Artificial Sequence
  Description of Artificial Sequence: Synthetic primer
ttttccaataatgtgacttc

SEQ ID NO: 252 - DNA, 20 bp, Artificial Sequence
  Description of Artificial Sequence: Synthetic primer
caatcccaaccgtaacaggc

SEQ ID NO: 253 - DNA, 19 bp, Artificial Sequence
  Description of Artificial Sequence: Synthetic primer
cttgatctcgcccaggaac

SEQ ID NO: 254 - DNA, 20 bp, Artificial Sequence
  Description of Artificial Sequence: Synthetic primer
gctcgctgaaggatgaagac

SEQ ID NO: 255 - DNA, 17 bp, Artificial Sequence
  Description of Artificial Sequence: Synthetic primer
gaatcgcttgaacccag

SEQ ID NO: 256 - DNA, 17 bp, Artificial Sequence
  Description of Artificial Sequence: Synthetic primer
ccaggtggtcttaacgg

SEQ ID NO: 257 - DNA, 21 bp, Artificial Sequence
  Description of Artificial Sequence: Synthetic primer
  modified_base (8)..(8): a, c, g, t, unknown or other
gaacgttnttcatgtaggcgt

SEQ ID NO: 258 - DNA, 16 bp, Artificial Sequence
  Description of Artificial Sequence: Synthetic primer
taatggtcgctgtccc

SEQ ID NO: 259 - DNA, 22 bp, Artificial Sequence
  Description of Artificial Sequence: Synthetic primer
agggaaaatggtatgtggggag

SEQ ID NO: 260 - DNA, 18 bp, Artificial Sequence
  Description of Artificial Sequence: Synthetic primer
gcagtgtgtgaaggcagg

SEQ ID NO: 261 - DNA, 24 bp, Artificial Sequence
  Description of Artificial Sequence: Synthetic primer
agtggacaaaatgaggaaaacagg

SEQ ID NO: 262 - DNA, 23 bp, Artificial Sequence
  Description of Artificial Sequence: Synthetic primer
ccaacacagtttgctcacatgcc

SEQ ID NO: 263 - DNA, 20 bp, Artificial Sequence
  Description of Artificial Sequence: Synthetic primer
tgacatctttgcattatggc

SEQ ID NO: 264 - DNA, 20 bp, Artificial Sequence
  Description of Artificial Sequence: Synthetic primer
agttatcccacctgataccg

SEQ ID NO: 265 - DNA, 20 bp, Artificial Sequence
  Description of Artificial Sequence: Synthetic primer
agctcttgcttctcagtcca

SEQ ID NO: 266 - DNA, 24 bp, Artificial Sequence
  Description of Artificial Sequence: Synthetic primer
caaaagttgtttctgtgtttgttc

SEQ ID NO: 267 - DNA, 22 bp, Artificial Sequence
  Description of Artificial Sequence: Synthetic primer
gcctctcaaagtagttggaacc

SEQ ID NO: 268 - DNA, 23 bp, Artificial Sequence
  Description of Artificial Sequence: Synthetic primer
tgtgtatccatagtgcaaaacag

SEQ ID NO: 269 - DNA, 19 bp, Artificial Sequence
  Description of Artificial Sequence: Synthetic primer
ctcaaggccaggcatcact

SEQ ID NO: 270 - DNA, 19 bp, Artificial Sequence
  Description of Artificial Sequence: Synthetic primer
ggactcttccatgccagtg

SEQ ID NO: 271 - DNA, 19 bp, Artificial Sequence
  Description of Artificial Sequence: Synthetic primer
aatgatgatctcaactctg

SEQ ID NO: 272 - DNA, 19 bp, Artificial Sequence
  Description of Artificial Sequence: Synthetic primer
actgaagaactcttgtcct

SEQ ID NO: 273 - DNA, 23 bp, Artificial Sequence
  Description of Artificial Sequence: Synthetic primer
gacatctgttagtctcataattc

SEQ ID NO: 274 - DNA, 18 bp, Artificial Sequence
  Description of Artificial Sequence: Synthetic primer
ggtaacagtgtcttgctt

SEQ ID NO: 275 - DNA, 21 bp, Artificial Sequence
  Description of Artificial Sequence: Synthetic primer
ctatgtacaaaacaggaagag

SEQ ID NO: 276 - DNA, 19 bp, Artificial Sequence
  Description of Artificial Sequence: Synthetic primer
atcctagtttcctctcctt

SEQ ID NO: 277 - DNA, 23 bp, Artificial Sequence
  Description of Artificial Sequence: Synthetic primer
gtaaatgagaaacagacaaatga

SEQ ID NO: 278 - DNA, 23 bp, Artificial Sequence
  Description of Artificial Sequence: Synthetic primer
ctattggatgtgatatgttatgg

SEQ ID NO: 279 - DNA, 22 bp, Artificial Sequence
  Description of Artificial Sequence: Synthetic primer
aagtagaaacaaaatgagggac

SEQ ID NO: 280 - DNA, 18 bp, Artificial Sequence
  Description of Artificial Sequence: Synthetic primer
cctaccccaaggtaacag

SEQ ID NO: 281 - DNA, 22 bp, Artificial Sequence
  Description of Artificial Sequence: Synthetic primer
acttcctataaatggaggtgag

SEQ ID NO: 282 - DNA, 18 bp, Artificial Sequence
  Description of Artificial Sequence: Synthetic primer
gaggagcttcaagaggaa

SEQ ID NO: 283 - DNA, 23 bp, Artificial Sequence
  Description of Artificial Sequence: Synthetic primer
catactcctagactcaaggaatc

SEQ ID NO: 284 - DNA, 23 bp, Artificial Sequence
  Description of Artificial Sequence: Synthetic primer
gaatgatgtacatgaattctttg

SEQ ID NO: 285 - DNA, 20 bp, Artificial Sequence
  Description of Artificial Sequence: Synthetic primer
gtgttgaggagaaaagcact

SEQ ID NO: 286 - DNA, 19 bp, Artificial Sequence
  Description of Artificial Sequence: Synthetic primer
ctcccagtagtcacattcc

SEQ ID NO: 287 - DNA, 23 bp, Artificial Sequence
  Description of Artificial Sequence: Synthetic primer
caagttacaaataacttaagccg

SEQ ID NO: 288 - DNA, 23 bp, Artificial Sequence
  Description of Artificial Sequence: Synthetic primer
caagaccctatctctacaaaaac

SEQ ID NO: 289 - DNA, 24 bp, Artificial Sequence
  Description of Artificial Sequence: Synthetic primer
tttattagaagtgactcttggccc

SEQ ID NO: 290 - DNA, 20 bp, Artificial Sequence
  Description of Artificial Sequence: Synthetic primer
gactacctgccctcagcttg

SEQ ID NO: 291 - DNA, 20 bp, Artificial Sequence
  Description of Artificial Sequence: Synthetic primer
ttctcatgtacaaagcggtc

SEQ ID NO: 292 - DNA, 20 bp, Artificial Sequence
  Description of Artificial Sequence: Synthetic primer
ccactggcttctctcttttt

SEQ ID NO: 293 - DNA, 18 bp, Artificial Sequence
  Description of Artificial Sequence: Synthetic primer
caccagaaggttggggtg

SEQ ID NO: 294 - DNA, 21 bp, Artificial Sequence
  Description of Artificial Sequence: Synthetic primer
actattacgacatgaacgcgg

SEQ ID NO: 295 - DNA, 18 bp, Artificial Sequence
  Description of Artificial Sequence: Synthetic primer
ctcatgctggatgacccc

SEQ ID NO: 296 - DNA, 24 bp, Artificial Sequence
  Description of Artificial Sequence: Synthetic primer
ttgcctttcttgaaacttaattcc

SEQ ID NO: 297 - DNA, 19 bp, Artificial Sequence
  Description of Artificial Sequence: Synthetic primer
tcacagccttcagtcaggg

SEQ ID NO: 298 - DNA, 18 bp, Artificial Sequence
  Description of Artificial Sequence: Synthetic primer
acatgctgtggcaccatg

SEQ ID NO: 299 - DNA, 18 bp, Artificial Sequence
  Description of Artificial Sequence: Synthetic primer
cctgagctactgccacag

SEQ ID NO: 300 - DNA, 20 bp, Artificial Sequence
  Description of Artificial Sequence: Synthetic primer
ccctgacttggacagtgtcc

SEQ ID NO: 301 - DNA, 18 bp, Artificial Sequence
  Description of Artificial Sequence: Synthetic primer
tcagagtcactcctgccc

SEQ ID NO: 302 - DNA, 22 bp, Artificial Sequence
  Description of Artificial Sequence: Synthetic primer
caaattcaagctcatccagacc

SEQ ID NO: 303 - DNA, 18 bp, Artificial Sequence
  Description of Artificial Sequence: Synthetic primer
cggcatttcatccaggac

SEQ ID NO: 304 - DNA, 20 bp, Artificial Sequence
  Description of Artificial Sequence: Synthetic primer
ggtgtaggaggtgcgacaat

SEQ ID NO: 305 - DNA, 20 bp, Artificial Sequence
  Description of Artificial Sequence: Synthetic primer
ttccatttattgagcacctg

SEQ ID NO: 306 - DNA, 20 bp, Artificial Sequence
  Description of Artificial Sequence: Synthetic primer
cttaagccactgtgttttgg

SEQ ID NO: 307 - DNA, 20 bp, Artificial Sequence
  Description of Artificial Sequence: Synthetic primer
cctcctacacctgcaaaagc

SEQ ID NO: 308 - DNA, 19 bp, Artificial Sequence
  Description of Artificial Sequence: Synthetic primer
tggaagaaccccagaggac

SEQ ID NO: 309 - DNA, 23 bp, Artificial Sequence
  Description of Artificial Sequence: Synthetic primer
aaagcacaaaagtaacagcaaca

SEQ ID NO: 310 - DNA, 20 bp, Artificial Sequence
  Description of Artificial Sequence: Synthetic primer
gtgtgtgggccacaatattg

SEQ ID NO: 311 - DNA, 20 bp, Artificial Sequence
  Description of Artificial Sequence: Synthetic primer
agagcacctttcctcagcac

SEQ ID NO: 312 - DNA, 20 bp, Artificial Sequence
  Description of Artificial Sequence: Synthetic primer
agaatctcatcacaggggcg

SEQ ID NO: 313 - DNA, 25 bp, Artificial Sequence
  Description of Artificial Sequence: Synthetic primer
aaaaaggacagtgtctaaaatttga

SEQ ID NO: 314 - DNA, 25 bp, Artificial Sequence
  Description of Artificial Sequence: Synthetic primer
aattgtttttgtttgttttttgagt

SEQ ID NO: 315 - DNA, 22 bp, Artificial Sequence
  Description of Artificial Sequence: Synthetic primer
gatttagggagtacaagtgcgg

SEQ ID NO: 316 - DNA, 25 bp, Artificial Sequence
  Description of Artificial Sequence: Synthetic primer
ggggacaaattatactttattcagg

SEQ ID NO: 317 - DNA, 22 bp, Artificial Sequence
  Description of Artificial Sequence: Synthetic primer
ccatcatcatattggtgtgacc

SEQ ID NO: 318 - DNA, 18 bp, Artificial Sequence
  Description of Artificial Sequence: Synthetic primer
tggctgcccaagaagaag

SEQ ID NO: 319 - DNA, 24 bp, Artificial Sequence
  Description of Artificial Sequence: Synthetic primer
ttaagatgccattaaactcatgac

SEQ ID NO: 320 - DNA, 20 bp, Artificial Sequence
  Description of Artificial Sequence: Synthetic primer
ccaaggagatgaccaagtgg

SEQ ID NO: 321 - DNA, 22 bp, Artificial Sequence
  Description of Artificial Sequence: Synthetic primer
ccatctcttttatcagggttgg

SEQ ID NO: 322 - DNA, 24 bp, Artificial Sequence
  Description of Artificial Sequence: Synthetic primer
ctctgtgcaagtaagcatcttaca

SEQ ID NO: 323 - DNA, 20 bp, Artificial Sequence
  Description of Artificial Sequence: Synthetic primer
cgactgtgtattttccacag

SEQ ID NO: 324 - DNA, 20 bp, Artificial Sequence
  Description of Artificial Sequence: Synthetic primer
agaagcccatatcaatgcac

SEQ ID NO: 325 - DNA, 23 bp, Artificial Sequence
  Description of Artificial Sequence: Synthetic primer
agcttaaagtaggacaaccatgg

SEQ ID NO: 326 - DNA, 20 bp, Artificial Sequence
  Description of Artificial Sequence: Synthetic primer
ggatgcttcactccagaaag

SEQ ID NO: 327 - DNA, 21 bp, Artificial Sequence
  Description of Artificial Sequence: Synthetic primer
tgttgtttatttccacctgcc

SEQ ID NO: 328 - DNA, 18 bp, Artificial Sequence
  Description of Artificial Sequence: Synthetic primer
agagtggctgcaggccag

SEQ ID NO: 329 - DNA, 25 bp, Artificial Sequence
  Description of Artificial Sequence: Synthetic primer
tttttttttttacacgaatttgagg

SEQ ID NO: 330 - DNA, 23 bp, Artificial Sequence
  Description of Artificial Sequence: Synthetic primer
tgaggaagtaaaaacaggtcatc

SEQ ID NO: 331 - DNA, 23 bp, Artificial Sequence
  Description of Artificial Sequence: Synthetic primer
atgaaatcttaagcagaatccca

SEQ ID NO: 332 - DNA, 20 bp, Artificial Sequence
  Description of Artificial Sequence: Synthetic primer
cacagagtcccagggtctgt

SEQ ID NO: 333 - DNA, 25 bp, Artificial Sequence
  Description of Artificial Sequence: Synthetic primer
aaaggcctttatttatctctctctg

SEQ ID NO: 334 - DNA, 18 bp, Artificial Sequence
  Description of Artificial Sequence: Synthetic primer
gcctcagagctggtgggt

SEQ ID NO: 335 - DNA, 25 bp, Artificial Sequence
  Description of Artificial Sequence: Synthetic primer
gcttctaagtcttagagtcagctgg

SEQ ID NO: 336 - DNA, 19 bp, Artificial Sequence
  Description of Artificial Sequence: Synthetic primer
agcccacagtcagcctacc

SEQ ID NO: 337 - DNA, 20 bp, Artificial Sequence
  Description of Artificial Sequence: Synthetic primer
ttggttaaatgatgcccaga

SEQ ID NO: 338 - DNA, 18 bp, Artificial Sequence
  Description of Artificial Sequence: Synthetic primer
tggtcccactcacatccc

SEQ ID NO: 339 - DNA, 19 bp, Artificial Sequence
  Description of Artificial Sequence: Synthetic primer
acacagcatgcagggagag

SEQ ID NO: 340 - DNA, 19 bp, Artificial Sequence
  Description of Artificial Sequence: Synthetic primer
atccctggtgcttaggtgg

SEQ ID NO: 341 - DNA, 21 bp, Artificial Sequence
  Description of Artificial Sequence: Synthetic primer
gatggaagtagctcctctcgg

SEQ ID NO: 342 - DNA, 21 bp, Artificial Sequence
  Description of Artificial Sequence: Synthetic primer
ggaaggccagcaagtactacc

SEQ ID NO: 343 - DNA, 18 bp, Artificial Sequence
  Description of Artificial Sequence: Synthetic primer
ccggtgcttggaaagatg

SEQ ID NO: 344 - DNA, 20 bp, Artificial Sequence
  Description of Artificial Sequence: Synthetic primer
gaagtgtctctgttggggga

SEQ ID NO: 345 - DNA, 22 bp, Artificial Sequence
  Description of Artificial Sequence: Synthetic primer
ttacaggcatgagtcactacgc

SEQ ID NO: 346 - DNA, 21 bp, Artificial Sequence
  Description of Artificial Sequence: Synthetic primer
accactctcacagcccttaca

SEQ ID NO: 347 - DNA, 18 bp, Artificial Sequence
  Description of Artificial Sequence: Synthetic primer
ccctccctccacacacac

SEQ ID NO: 348 - DNA, 20 bp, Artificial Sequence
  Description of Artificial Sequence: Synthetic primer
gctcactgaactttcagggc

SEQ ID NO: 349 - DNA, 20 bp, Artificial Sequence
  Description of Artificial Sequence: Synthetic primer
agatacgggcaaaacactgg

SEQ ID NO: 350 - DNA, 21 bp, Artificial Sequence
  Description of Artificial Sequence: Synthetic primer
gttgaatatagagcagggccc

SEQ ID NO: 351 - DNA, 20 bp, Artificial Sequence
  Description of Artificial Sequence: Synthetic primer
ttctgaggtcagggctgtct

SEQ ID NO: 352 - DNA, 21 bp, Artificial Sequence
  Description of Artificial Sequence: Synthetic primer
agcttggaaaatctcgtgtca

SEQ ID NO: 353 - DNA, 18 bp, Artificial Sequence
  Description of Artificial Sequence: Synthetic primer
actcagtccctcccaccc

SEQ ID NO: 354 - DNA, 20 bp, Artificial Sequence
  Description of Artificial Sequence: Synthetic primer
tcctctcactccttcccaga

SEQ ID NO: 355 - DNA, 19 bp, Artificial Sequence
  Description of Artificial Sequence: Synthetic primer
gtgatcacggctcaacctg

SEQ ID NO: 356 - DNA, 18 bp, Artificial Sequence
  Description of Artificial Sequence: Synthetic primer
tggaggactgcttgagcc

SEQ ID NO: 357 - DNA, 19 bp, Artificial Sequence
  Description of Artificial Sequence: Synthetic primer
ctgcagctgcctcagtttc

SEQ ID NO: 358 - DNA, 20 bp, Artificial Sequence
  Description of Artificial Sequence: Synthetic primer
tcaaaagtgctggtgacagc

SEQ ID NO: 359 - DNA, 20 bp, Artificial Sequence
  Description of Artificial Sequence: Synthetic primer
atttccagagccagctcaaa

SEQ ID NO: 360 - DNA, 25 bp, Artificial Sequence
  Description of Artificial Sequence: Synthetic primer
ctttaatgttgtgatgacacaaagc

SEQ ID NO: 361 - DNA, 20 bp, Artificial Sequence
  Description of Artificial Sequence: Synthetic primer
gatcatgcactgttgaccac

SEQ ID NO: 362 - DNA, 25 bp, Artificial Sequence
  Description of Artificial Sequence: Synthetic primer
tacatttgaaacatttaaaacctga

SEQ ID NO: 363 - DNA, 24 bp, Artificial Sequence
  Description of Artificial Sequence: Synthetic primer
aactgagctgtaaccagactggga

SEQ ID NO: 364 - DNA, 22 bp, Artificial Sequence
  Description of Artificial Sequence: Synthetic primer
tggaacagtctggtcctgatgg

SEQ ID NO: 365 - DNA, 25 bp, Artificial Sequence
  Description of Artificial Sequence: Synthetic primer
ttatccctttattgtttctcctttg

SEQ ID NO: 366 - DNA, 24 bp, Artificial Sequence
  Description of Artificial Sequence: Synthetic primer
tggtcacctgtatttattgctagg

SEQ ID NO: 367 - DNA, 22 bp, Artificial Sequence
  Description of Artificial Sequence: Synthetic primer
tcttcaaagcctctgcagtacc

SEQ ID NO: 368 - DNA, 22 bp, Artificial Sequence
  Description of Artificial Sequence: Synthetic primer
ctcatctccaacctgtctaacc

SEQ ID NO: 369 - DNA, 24 bp, Artificial Sequence
  Description of Artificial Sequence: Synthetic primer
gtggctgcagctaatgtaagacac

SEQ ID NO: 370 - DNA, 24 bp, Artificial Sequence
  Description of Artificial Sequence: Synthetic primer
cagcagagacaatggcgtaagtcc

SEQ ID NO: 371 - DNA, 20 bp, Artificial Sequence
  Description of Artificial Sequence: Synthetic primer
ctgattgagaaccagaacag

SEQ ID NO: 372 - DNA, 20 bp, Artificial Sequence
  Description of Artificial Sequence: Synthetic primer
taaagccctataacctctcc

SEQ ID NO: 373 - DNA, 20 bp, Artificial Sequence
  Description of Artificial Sequence: Synthetic primer
tagtaagggaccttcaccag

SEQ ID NO: 374 - DNA, 20 bp, Artificial Sequence
  Description of Artificial Sequence: Synthetic primer
agatgtttggtatgacttgg

SEQ ID NO: 375 - DNA, 20 bp, Artificial Sequence
  Description of Artificial Sequence: Synthetic primer
gatgattaaactctcctggc

SEQ ID NO: 376 - DNA, 20 bp, Artificial Sequence
  Description of Artificial Sequence: Synthetic primer
gagacagctaagcactcatg

SEQ ID NO: 377 - DNA, 19 bp, Artificial Sequence
  Description of Artificial Sequence: Synthetic primer
gaggtggtgggcacctgta

SEQ ID NO: 378 - DNA, 20 bp, Artificial Sequence
  Description of Artificial Sequence: Synthetic primer
agaggggaggaacacacctt

SEQ ID NO: 379 - DNA, 20 bp, Artificial Sequence
  Description of Artificial Sequence: Synthetic primer
gaccagagtctgcccagaag

SEQ ID NO: 380 - DNA, 19 bp, Artificial Sequence
  Description of Artificial Sequence: Synthetic primer
tccccagctctatcccaac

SEQ ID NO: 381 - DNA, 20 bp, Artificial Sequence
  Description of Artificial Sequence: Synthetic primer
ggagggatggacaagtctga

SEQ ID NO: 382 - DNA, 20 bp, Artificial Sequence
  Description of Artificial Sequence: Synthetic primer
gtccagctcgctgactatcc

SEQ ID NO: 383 - DNA, 20 bp, Artificial Sequence
  Description of Artificial Sequence: Synthetic primer
tcaaaacacagtcatctcca

SEQ ID NO: 384 - DNA, 20 bp, Artificial Sequence
  Description of Artificial Sequence: Synthetic primer
gcaaaggctttaccatattg

SEQ ID NO: 385 - DNA, 16 bp, Artificial Sequence
  Description of Artificial Sequence: Synthetic primer
gctcagcacccccatt

SEQ ID NO: 386 - DNA, 16 bp, Artificial Sequence
  Description of Artificial Sequence: Synthetic primer
tccctgctcgggaaac

SEQ ID NO: 387 - DNA, 20 bp, Artificial Sequence
  Description of Artificial Sequence: Synthetic primer
gttctccagagagacagcac

SEQ ID NO: 388 - DNA, 19 bp, Artificial Sequence
  Description of Artificial Sequence: Synthetic primer
gagagcaacactattgccc

SEQ ID NO: 389 - DNA, 21 bp, Artificial Sequence
  Description of Artificial Sequence: Synthetic primer
tatagacttcagccctgctgc

SEQ ID NO: 390 - DNA, 20 bp, Artificial Sequence
  Description of Artificial Sequence: Synthetic primer
cctctgtaggatgcagttgg

SEQ ID NO: 391 - DNA, 20 bp, Artificial Sequence
  Description of Artificial Sequence: Synthetic primer
ttgctacgcactcctctact

SEQ ID NO: 392 - DNA, 20 bp, Artificial Sequence
  Description of Artificial Sequence: Synthetic primer
gtgaaggcaggaaatgtgac

SEQ ID NO: 393 - DNA, 20 bp, Artificial Sequence
  Description of Artificial Sequence: Synthetic primer
atcctagaccagaggagccc

SEQ ID NO: 394 - DNA, 20 bp, Artificial Sequence
  Description of Artificial Sequence: Synthetic primer
ctccccctggtccagttatt

SEQ ID NO: 395 - DNA, 20 bp, Artificial Sequence
  Description of Artificial Sequence: Synthetic primer
aactttcatttgccaaggga

SEQ ID NO: 396 - DNA, 20 bp, Artificial Sequence
  Description of Artificial Sequence: Synthetic primer
agcagatctgctcttgcgat

SEQ ID NO: 397 - DNA, 20 bp, Artificial Sequence
  Description of Artificial Sequence: Synthetic primer
acagttgtcatcggtaggca

SEQ ID NO: 398 - DNA, 22 bp, Artificial Sequence
  Description of Artificial Sequence: Synthetic primer
aaaagtatgaatgggatggagc

SEQ ID NO: 399 - DNA, 20 bp, Artificial Sequence
  Description of Artificial Sequence: Synthetic primer
gtgcaggtggcgtttatttt

SEQ ID NO: 400 - DNA, 21 bp, Artificial Sequence
  Description of Artificial Sequence: Synthetic primer
ccctatatctccgtgtgctcc

SEQ ID NO: 401 - DNA, 21 bp, Artificial Sequence
  Description of Artificial Sequence: Synthetic primer
gctctagtgggaaacctcagg

SEQ ID NO: 402 - DNA, 20 bp, Artificial Sequence
  Description of Artificial Sequence: Synthetic primer
gaattccaggctcttgcttg

SEQ ID NO: 403 - DNA, 20 bp, Artificial Sequence
  Description of Artificial Sequence: Synthetic primer
ggtttggtctcaaaggcaaa

SEQ ID NO: 404 - DNA, 20 bp, Artificial Sequence
  Description of Artificial Sequence: Synthetic primer
ccagtacatggtggtcacca

SEQ ID NO: 405 - DNA, 20 bp, Artificial Sequence
  Description of Artificial Sequence: Synthetic primer
gctgccttggaatttctgtt

SEQ ID NO: 406 - DNA, 18 bp, Artificial Sequence
  Description of Artificial Sequence: Synthetic primer
gtgctgtggtggggaaag

SEQ ID NO: 407 - DNA, 20 bp, Artificial Sequence
  Description of Artificial Sequence: Synthetic primer
attcaagctcatccagaccc

SEQ ID NO: 408 - DNA, 20 bp, Artificial Sequence
  Description of Artificial Sequence: Synthetic primer
ggactggccctttgaaactc

SEQ ID NO: 409 - DNA, 22 bp, Artificial Sequence
  Description of Artificial Sequence: Synthetic primer
atattgaccgtgcacaaatacg

SEQ ID NO: 410 - DNA, 21 bp, Artificial Sequence
  Description of Artificial Sequence: Synthetic primer
agacctgggaaaagtggagaa

SEQ ID NO: 411 - DNA, 20 bp, Artificial Sequence
  Description of Artificial Sequence: Synthetic primer
attggcagtggaaaatgctt

SEQ ID NO: 412 - DNA, 25 bp, Artificial Sequence
  Description of Artificial Sequence: Synthetic primer
ttaatcttttgtcaacttcctgatt

SEQ ID NO: 413 - DNA, 23 bp, Artificial Sequence
  Description of Artificial Sequence: Synthetic primer
tctgtcctcctttcaccggaagc

SEQ ID NO: 414 - DNA, 29 bp, Artificial Sequence
  Description of Artificial Sequence: Synthetic primer
ggataaagaaactccgctctgctggtaga

SEQ ID NO: 415 - DNA, 25 bp, Artificial Sequence
  Description of Artificial Sequence: Synthetic primer
tcagggcctgtgttgccgcactctg

SEQ ID NO: 416 - DNA, 28 bp, Artificial Sequence
  Description of Artificial Sequence: Synthetic primer
agcgatgtaaagggtaccagtgccgagg

SEQ ID NO: 417 - DNA, 18 bp, Artificial Sequence
  Description of Artificial Sequence: Synthetic primer
aggcatgcaagcttctta

SEQ ID NO: 418 - DNA, 18 bp, Artificial Sequence
  Description of Artificial Sequence: Synthetic primer
ccgggaggagacatctat

SEQ ID NO: 419 - DNA, 19 bp, Artificial Sequence
  Description of Artificial Sequence: Synthetic primer
tggtaagcacagaaaatgc

SEQ ID NO: 420 - DNA, 18 bp, Artificial Sequence
  Description of Artificial Sequence: Synthetic primer
aatggatgggggattatt

SEQ ID NO: 421 - DNA, 18 bp, Artificial Sequence
  Description of Artificial Sequence: Synthetic primer
ctggacgttatgtctgcc

SEQ ID NO: 422 - DNA, 18 bp, Artificial Sequence
  Description of Artificial Sequence: Synthetic primer
agaggcccagtcacagat

SEQ ID NO: 423 - DNA, 19 bp, Artificial Sequence
  Description of Artificial Sequence: Synthetic primer
atcactctgaactgccact

SEQ ID NO: 424 - DNA, 20 bp, Artificial Sequence
  Description of Artificial Sequence: Synthetic primer
cccttctgtttttctgtttt

SEQ ID NO: 425 - DNA, 18 bp, Artificial Sequence
  Description of Artificial Sequence: Synthetic primer
caagctttgaaggaagag

SEQ ID NO: 426 - DNA, 19 bp, Artificial Sequence
  Description of Artificial Sequence: Synthetic primer
taggacgttaagtgaggac

SEQ ID NO: 427 - DNA, 18 bp, Artificial Sequence
  Description of Artificial Sequence: Synthetic primer
gctctgcagtgggtaaaa

SEQ ID NO: 428 - DNA, 18 bp, Artificial Sequence
  Description of Artificial Sequence: Synthetic primer
actctccaagactgtgcg

SEQ ID NO: 429 - DNA, 18 bp, Artificial Sequence
  Description of Artificial Sequence: Synthetic primer
ccctttctgaggcaagat

SEQ ID NO: 430 - DNA, 18 bp, Artificial Sequence
  Description of Artificial Sequence: Synthetic primer
gaccacctgggagagaac

SEQ ID NO: 431 - DNA, 18 bp, Artificial Sequence
  Description of Artificial Sequence: Synthetic primer
cgctatgagtcccatctg

SEQ ID NO: 432 - DNA, 18 bp, Artificial Sequence
  Description of Artificial Sequence: Synthetic primer
gatcagctgcaatgaagg

SEQ ID NO: 433 - DNA, 18 bp, Artificial Sequence
  Description of Artificial Sequence: Synthetic primer
ttgagtacacggggtgac

SEQ ID NO: 434 - DNA, 18 bp, Artificial Sequence
  Description of Artificial Sequence: Synthetic primer
cgcaggactgaaagatga

SEQ ID NO: 435 - DNA, 18 bp, Artificial Sequence
  Description of Artificial Sequence: Synthetic primer
acctgtctcctctcctgg

SEQ ID NO: 436 - DNA, 18 bp, Artificial Sequence
  Description of Artificial Sequence: Synthetic primer
tgcttttcttctgtggga

SEQ ID NO: 437 - DNA, 18 bp, Artificial Sequence
  Description of Artificial Sequence: Synthetic primer
atgaccagcaagcattgt

SEQ ID NO: 438 - DNA, 18 bp, Artificial Sequence
  Description of Artificial Sequence: Synthetic primer
gtactgggattacaggcg

SEQ ID NO: 439 - DNA, 18 bp, Artificial Sequence
  Description of Artificial Sequence: Synthetic primer
gcagaaggtcctttggat

SEQ ID NO: 440 - DNA, 18 bp, Artificial Sequence
  Description of Artificial Sequence: Synthetic primer
tttgcaggattcatgctt

SEQ ID NO: 441 - DNA, 19 bp, Artificial Sequence
  Description of Artificial Sequence: Synthetic primer
cgacattcttttctggagg

SEQ ID NO: 442 - DNA, 19 bp, Artificial Sequence
  Description of Artificial Sequence: Synthetic primer
acctttgcatgttggtttt

SEQ ID NO: 443 - DNA, 18 bp, Artificial Sequence
  Description of Artificial Sequence: Synthetic primer
gcacttttccttccttcc

SEQ ID NO: 444 - DNA, 18 bp, Artificial Sequence
  Description of Artificial Sequence: Synthetic primer
tgctttgctttcttctgg

SEQ ID NO: 445 - DNA, 19 bp, Artificial Sequence
  Description of Artificial Sequence: Synthetic primer
acagctccagagagaagga

SEQ ID NO: 446 - DNA, 19 bp, Artificial Sequence
  Description of Artificial Sequence: Synthetic primer
gcagtcacttgaaaccaga

SEQ ID NO: 447 - DNA, 18 bp, Artificial Sequence
  Description of Artificial Sequence: Synthetic primer
aggcatcaagctttcctt

SEQ ID NO: 448 - DNA, 18 bp, Artificial Sequence
  Description of Artificial Sequence: Synthetic primer
ggtttagagaaccgagcc

SEQ ID NO: 449 - DNA, 18 bp, Artificial Sequence
  Description of Artificial Sequence: Synthetic primer
gtggtgctgcaagttacc

SEQ ID NO: 450 - DNA, 18 bp, Artificial Sequence
  Description of Artificial Sequence: Synthetic primer
ggaatccctttctttcca

SEQ ID NO: 451 - DNA, 18 bp, Artificial Sequence
  Description of Artificial Sequence: Synthetic primer
gaccatttgttacgcagc

SEQ ID NO: 452 - DNA, 19 bp, Artificial Sequence
  Description of Artificial Sequence: Synthetic primer
gatgggtgtgaatgaacaa

SEQ ID NO: 453 - DNA, 19 bp, Artificial Sequence
  Description of Artificial Sequence: Synthetic primer
ctcaagcttctgttcatgc

SEQ ID NO: 454 - DNA, 18 bp, Artificial Sequence
  Description of Artificial Sequence: Synthetic primer
gctgtgagtgtcttggct

SEQ ID NO: 455 - DNA, 18 bp, Artificial Sequence
  Description of Artificial Sequence: Synthetic primer
tacagaaaaccgcagctc

SEQ ID NO: 456 - DNA, 18 bp, Artificial Sequence
  Description of Artificial Sequence: Synthetic primer
gccaccaaaggaaagatt

SEQ ID NO: 457 - DNA, 18 bp, Artificial Sequence
  Description of Artificial Sequence: Synthetic primer
aaaaggagggaatcatgg

SEQ ID NO: 458 - DNA, 18 bp, Artificial Sequence
  Description of Artificial Sequence: Synthetic primer
tcacttagcaggaggcag

SEQ ID NO: 459 - DNA, 18 bp, Artificial Sequence
  Description of Artificial Sequence: Synthetic primer
ctgagcatccgatgagac

SEQ ID NO: 460 - DNA, 18 bp, Artificial Sequence
  Description of Artificial Sequence: Synthetic primer
gtgcaaaatgagcagctt

SEQ ID NO: 461 - DNA, 18 bp, Artificial Sequence
  Description of Artificial Sequence: Synthetic primer
tctaaccccttactgggc

SEQ ID NO: 462 - DNA, 18 bp, Artificial Sequence
  Description of Artificial Sequence: Synthetic primer
tcctcaaactgggaatga

SEQ ID NO: 463 - DNA, 18 bp, Artificial Sequence
  Description of Artificial Sequence: Synthetic primer
tttacacaggaccaggga

SEQ ID NO: 464 - DNA, 18 bp, Artificial Sequence
  Description of Artificial Sequence: Synthetic primer
atctcccccactcagaag

SEQ ID NO: 465 - DNA, 18 bp, Artificial Sequence
  Description of Artificial Sequence: Synthetic primer
gtccacgggctttattct

SEQ ID NO: 466 - DNA, 22 bp, Artificial Sequence
  Description of Artificial Sequence: Synthetic primer
tgagcataaatttcattagctg

SEQ ID NO: 467 - DNA, 20 bp, Artificial Sequence
  Description of Artificial Sequence: Synthetic primer
ggaagagcaaaataaatcca

SEQ ID NO: 468 - DNA, 19 bp, Artificial Sequence
  Description of Artificial Sequence: Synthetic primer
ggtgcacagaattgttcat

SEQ ID NO: 469 - DNA, 18 bp, Artificial Sequence
  Description of Artificial Sequence: Synthetic primer
agcacgcttatttcatgg

SEQ ID NO: 470 - DNA, 18 bp, Artificial Sequence
  Description of Artificial Sequence: Synthetic primer
gtaacaccagcagggaca

SEQ ID NO: 471 - DNA, 18 bp, Artificial Sequence
  Description of Artificial Sequence: Synthetic primer
tcctgctgcattatggat

SEQ ID NO: 472 - DNA, 18 bp, Artificial Sequence
  Description of Artificial Sequence: Synthetic primer
gggggtgagaagtaggaa

SEQ ID NO: 473 - DNA, 18 bp, Artificial Sequence
  Description of Artificial Sequence: Synthetic primer
atggggattaaatacggg

SEQ ID NO: 474 - DNA, 18 bp, Artificial Sequence
  Description of Artificial Sequence: Synthetic primer
agctagcattgggctctt

SEQ ID NO: 475 - DNA, 18 bp, Artificial Sequence
  Description of Artificial Sequence: Synthetic primer
ctgaggagaagaggctgg

SEQ ID NO: 476 - DNA, 18 bp, Artificial Sequence
  Description of Artificial Sequence: Synthetic primer
cgccttacaaggcaagta

SEQ ID NO: 477 - DNA, 18 bp, Artificial Sequence
  Description of Artificial Sequence: Synthetic primer
aggatgcttgctagggtt

SEQ ID NO: 478 - DNA, 18 bp, Artificial Sequence
  Description of Artificial Sequence: Synthetic primer
cacaagtgtctggaaggc

SEQ ID NO: 479 - DNA, 18 bp, Artificial Sequence
  Description of Artificial Sequence: Synthetic primer
ggtctcaggagcccttta

SEQ ID NO: 480 - DNA, 21 bp, Artificial Sequence
  Description of Artificial Sequence: Synthetic primer
acatgccactcttctcactaa

SEQ ID NO: 481 - DNA, 18 bp, Artificial Sequence
  Description of Artificial Sequence: Synthetic primer
acttaaccaaggatgggg

SEQ ID NO: 482 - DNA, 18 bp, Artificial Sequence
  Description of Artificial Sequence: Synthetic primer
caacccacgagcataaga

SEQ ID NO: 483 - DNA, 18 bp, Artificial Sequence
  Description of Artificial Sequence: Synthetic primer
taggctctgcactcttgg

SEQ ID NO: 484 - DNA, 18 bp, Artificial Sequence
  Description of Artificial Sequence: Synthetic primer
acccacggagtctctctc

SEQ ID NO: 485 - DNA, 18 bp, Artificial Sequence
  Description of Artificial Sequence: Synthetic primer
taaaggcggtgaagtgag

SEQ ID NO: 486 - DNA, 18 bp, Artificial Sequence
  Description of Artificial Sequence: Synthetic primer
ctaccgctctcctaggct

SEQ ID NO: 487 - DNA, 18 bp, Artificial Sequence
  Description of Artificial Sequence: Synthetic primer
tggggccagataattctt

SEQ ID NO: 488 - DNA, 18 bp, Artificial Sequence
  Description of Artificial Sequence: Synthetic primer
ctggtgtttggtggtgtt

SEQ ID NO: 489 - DNA, 18 bp, Artificial Sequence
  Description of Artificial Sequence: Synthetic primer
aaggaagaggtcaccagg

SEQ ID NO: 490 - DNA, 18 bp, Artificial Sequence
  Description of Artificial Sequence: Synthetic primer
cacaaattccatttccca

SEQ ID NO: 491 - DNA, 21 bp, Artificial Sequence
  Description of Artificial Sequence: Synthetic primer
tcaataggtgatccaacattt

SEQ ID NO: 492 - DNA, 18 bp, Artificial Sequence
  Description of Artificial Sequence: Synthetic primer
aaagtcccacaaagggtc

SEQ ID NO: 493 - DNA, 18 bp, Artificial Sequence
  Description of Artificial Sequence: Synthetic primer
gggtagggggatcttttt

SEQ ID NO: 494 - DNA, 18 bp, Artificial Sequence
  Description of Artificial Sequence: Synthetic primer
tgtggaacattcattggc

SEQ ID NO: 495 - DNA, 18 bp, Artificial Sequence
  Description of Artificial Sequence: Synthetic primer
gtcctgggaaagatggaa

SEQ ID NO: 496 - DNA, 18 bp, Artificial Sequence
  Description of Artificial Sequence: Synthetic primer
tcaaagcgtctcccataa

SEQ ID NO: 497 - DNA, 18 bp, Artificial Sequence
  Description of Artificial Sequence: Synthetic primer
tctttcgctgtacttggc

SEQ ID NO: 498 - DNA, 18 bp, Artificial Sequence
  Description of Artificial Sequence: Synthetic primer
tgggaggtcagagtgatg

SEQ ID NO: 499 - DNA, 19 bp, Artificial Sequence
  Description of Artificial Sequence: Synthetic primer
ggacagtgtatgtgttggg

SEQ ID NO: 500 - DNA, 18 bp, Artificial Sequence
  Description of Artificial Sequence: Synthetic primer
aggcagctgtttttgtga

SEQ ID NO: 501 - DNA, 18 bp, Artificial Sequence
  Description of Artificial Sequence: Synthetic primer
cttcttgagtcccgtgtg

SEQ ID NO: 502 - DNA, 19 bp, Artificial Sequence
  Description of Artificial Sequence: Synthetic primer
caaccgagaatcctctagc

SEQ ID NO: 503 - DNA, 18 bp, Artificial Sequence
  Description of Artificial Sequence: Synthetic primer
gctgggagagaatcacaa

SEQ ID NO: 504 - DNA, 18 bp, Artificial Sequence
  Description of Artificial Sequence: Synthetic primer
gctttgcagaagagacca

SEQ ID NO: 505 - DNA, 18 bp, Artificial Sequence
  Description of Artificial Sequence: Synthetic primer
acgctgtcaggtcacact

SEQ ID NO: 506 - DNA, 18 bp, Artificial Sequence
  Description of Artificial Sequence: Synthetic primer
ggaggatgctcaggtgat

SEQ ID NO: 507 - DNA, 18 bp, Artificial Sequence
  Description of Artificial Sequence: Synthetic primer
tagggggatctttttcca

SEQ ID NO: 508 - DNA, 18 bp, Artificial Sequence
  Description of Artificial Sequence: Synthetic primer
gagcaatttgaaaagcca

SEQ ID NO: 509 - DNA, 18 bp, Artificial Sequence
  Description of Artificial Sequence: Synthetic primer
atggtccagctcctctgt

SEQ ID NO: 510 - DNA, 18 bp, Artificial Sequence
  Description of Artificial Sequence: Synthetic primer
atagagcaccccatctcc

SEQ ID NO: 511 - DNA, 18 bp, Artificial Sequence
  Description of Artificial Sequence: Synthetic primer
aacattgctgttagccca

SEQ ID NO: 512 - DNA, 18 bp, Artificial Sequence
  Description of Artificial Sequence: Synthetic primer
gcaatcgaaacagcattc

SEQ ID NO: 513 - DNA, 18 bp, Artificial Sequence
  Description of Artificial Sequence: Synthetic primer
atgagttggcagctgaag

SEQ ID NO: 514 - DNA, 18 bp, Artificial Sequence
  Description of Artificial Sequence: Synthetic primer
aatgaaggtcttgcctcc

SEQ ID NO: 515 - DNA, 20 bp, Artificial Sequence
  Description of Artificial Sequence: Synthetic primer
gaggagaagatccacaagcg

SEQ ID NO: 516 - DNA, 20 bp, Artificial Sequence
  Description of Artificial Sequence: Synthetic primer
tctctggggcatactgaacc

SEQ ID NO: 517 - DNA, 18 bp, Artificial Sequence
  Description of Artificial Sequence: Synthetic primer
ctgagcttttggcactgt

SEQ ID NO: 518 - DNA, 18 bp, Artificial Sequence
  Description of Artificial Sequence: Synthetic primer
ctgctaggtgacagcagg

SEQ ID NO: 519 - DNA, 20 bp, Artificial Sequence
  Description of Artificial Sequence: Synthetic primer
tgtatgagtctggagggtgt

SEQ ID NO: 520 - DNA, 18 bp, Artificial Sequence
  Description of Artificial Sequence: Synthetic primer
acacctggctgaggaaat

SEQ ID NO: 521 - DNA, 18 bp, Artificial Sequence
  Description of Artificial Sequence: Synthetic primer
gcaggggacgtgataata

SEQ ID NO: 522 - DNA, 18 bp, Artificial Sequence
  Description of Artificial Sequence: Synthetic primer
ttttgcttcctaccatgc

SEQ ID NO: 523 - DNA, 18 bp, Artificial Sequence
  Description of Artificial Sequence: Synthetic primer
aaaattgtgagcacctcc

SEQ ID NO: 524 - DNA, 23 bp, Artificial Sequence
  Description of Artificial Sequence: Synthetic primer
tttatatttaaagtggctttgtt

SEQ ID NO: 525 - DNA, 18 bp, Artificial Sequence
  Description of Artificial Sequence: Synthetic primer
gtgcaaagcccacagtat

SEQ ID NO: 526 - DNA, 18 bp, Artificial Sequence
  Description of Artificial Sequence: Synthetic primer
aggaaaatgcaagagcag

SEQ ID NO: 527 - DNA, 20 bp, Artificial Sequence
  Description of Artificial Sequence: Synthetic primer
ccactgaattgcatactttg

SEQ ID NO: 528 - DNA, 18 bp, Artificial Sequence
  Description of Artificial Sequence: Synthetic primer
tctgggtccagtctgcta

SEQ ID NO: 529 - DNA, 18 bp, Artificial Sequence
  Description of Artificial Sequence: Synthetic primer
agattttggggagtcagg

SEQ ID NO: 530 - DNA, 17 bp, Artificial Sequence
  Description of Artificial Sequence: Synthetic primer
gcgctcaagcaattctc

SEQ ID NO: 531 - DNA, 18 bp, Artificial Sequence
  Description of Artificial Sequence: Synthetic primer
caagccccaaagtagtca

SEQ ID NO: 532 - DNA, 18 bp, Artificial Sequence
  Description of Artificial Sequence: Synthetic primer
gaatcatccaatccacga

SEQ ID NO: 533 - DNA, 18 bp, Artificial Sequence
  Description of Artificial Sequence: Synthetic primer
agcctccaggtgactacc

SEQ ID NO: 534 - DNA, 18 bp, Artificial Sequence
  Description of Artificial Sequence: Synthetic primer
gaaggacatggtcagcag

SEQ ID NO: 535 - DNA, 18 bp, Artificial Sequence
  Description of Artificial Sequence: Synthetic primer
atgctttcagcattttcg

SEQ ID NO: 536 - DNA, 18 bp, Artificial Sequence
  Description of Artificial Sequence: Synthetic primer
tgatccgtggtagggtta

SEQ ID NO: 537 - DNA, 18 bp, Artificial Sequence
  Description of Artificial Sequence: Synthetic primer
gtcggattggtttcacaa

SEQ ID NO: 538 - DNA, 19 bp, Artificial Sequence
  Description of Artificial Sequence: Synthetic primer
ttttatgggaatttcagcc

SEQ ID NO: 539 - DNA, 21 bp, Artificial Sequence
  Description of Artificial Sequence: Synthetic primer
tttggaaaagaacagaaatgt

SEQ ID NO: 540 - DNA, 19 bp, Artificial Sequence
  Description of Artificial Sequence: Synthetic primer
ggctagtctttcctgaacc

SEQ ID NO: 541 - DNA, 18 bp, Artificial Sequence
  Description of Artificial Sequence: Synthetic primer
ccttaatgcccctgattc

SEQ ID NO: 542 - DNA, 18 bp, Artificial Sequence
  Description of Artificial Sequence: Synthetic primer
gcgtttacaagctgagga

SEQ ID NO: 543 - DNA, 18 bp, Artificial Sequence
  Description of Artificial Sequence: Synthetic primer
tcaagcttgctttctcaa

SEQ ID NO: 544 - DNA, 18 bp, Artificial Sequence
  Description of Artificial Sequence: Synthetic primer
gtagcccagcaagtgtct

SEQ ID NO: 545 - DNA, 18 bp, Artificial Sequence
  Description of Artificial Sequence: Synthetic primer
cctggctggagataggat

SEQ ID NO: 546 - DNA, 18 bp, Artificial Sequence
  Description of Artificial Sequence: Synthetic primer
cttcccctctgcctatgt

SEQ ID NO: 547 - DNA, 18 bp, Artificial Sequence
  Description of Artificial Sequence: Synthetic primer
ggcacgtacttcctacca

SEQ ID NO: 548 - DNA, 18 bp, Artificial Sequence
  Description of Artificial Sequence: Synthetic primer
ggtgcttcttacaggcaa

SEQ ID NO: 549 - DNA, 16 bp, Artificial Sequence
  Description of Artificial Sequence: Synthetic primer
acccaggctggtgtgt

SEQ ID NO: 550 - DNA, 23 bp, Artificial Sequence
  Description of Artificial Sequence: Synthetic primer
actgagttaattatcactcccct

SEQ ID NO: 551 - DNA, 18 bp, Artificial Sequence
  Description of Artificial Sequence: Synthetic primer
gatgcattttgcttcacc

SEQ ID NO: 552 - DNA, 21 bp, Artificial Sequence
  Description of Artificial Sequence: Synthetic primer
tctgcttttagagctgttagc

SEQ ID NO: 553 - DNA, 19 bp, Artificial Sequence
  Description of Artificial Sequence: Synthetic primer
tcaagcttcaaagagcaga

SEQ ID NO: 554 - DNA, 18 bp, Artificial Sequence
  Description of Artificial Sequence: Synthetic primer
ggagtacatcccaggacc

SEQ ID NO: 555 - DNA, 19 bp, Artificial Sequence
  Description of Artificial Sequence: Synthetic primer
tggtgcttttaaatccaga

SEQ ID NO: 556 - DNA, 21 bp, Artificial Sequence
  Description of Artificial Sequence: Synthetic primer
ctcccttacttacttgcattg

SEQ ID NO: 557 - DNA, 18 bp, Artificial Sequence
  Description of Artificial Sequence: Synthetic primer
tcttctcccagggaatct

SEQ ID NO: 558 - DNA, 18 bp, Artificial Sequence
  Description of Artificial Sequence: Synthetic primer
tttatgtcccctgagcac

SEQ ID NO: 559 - DNA, 19 bp, Artificial Sequence
  Description of Artificial Sequence: Synthetic primer
tccctggctatcttgaatc

SEQ ID NO: 560 - DNA, 16 bp, Artificial Sequence
  Description of Artificial Sequence: Synthetic primer
cttgactgggtccacg

SEQ ID NO: 561 - DNA, 20 bp, Artificial Sequence
  Description of Artificial Sequence: Synthetic primer
cgagacgccagtagatacca

SEQ ID NO: 562 - DNA, 20 bp, Artificial Sequence
  Description of Artificial Sequence: Synthetic primer
catcctccatgcctttcagt

SEQ ID NO: 563 - DNA, 20 bp, Artificial Sequence
  Description of Artificial Sequence: Synthetic primer
agttccagagaacgagacgc

SEQ ID NO: 564 - DNA, 20 bp, Artificial Sequence
  Description of Artificial Sequence: Synthetic primer
cttgtcatcctccatgcctt

SEQ ID NO: 565 - DNA, 20 bp, Artificial Sequence
  Description of Artificial Sequence: Synthetic primer
gagcgtgagaggttgaggag

SEQ ID NO: 566 - DNA, 20 bp, Artificial Sequence
  Description of Artificial Sequence: Synthetic primer
aaacaaactccagacgcacc

SEQ ID NO: 567 - DNA, 24 bp, Artificial Sequence
  Description of Artificial Sequence: Synthetic primer
ctgaaccactacctgtatgacctg

SEQ ID NO: 568 - DNA, 25 bp, Artificial Sequence
  Description of Artificial Sequence: Synthetic primer
ctaactacttactcctacagggccc

SEQ ID NO: 569 - DNA, 23 bp, Artificial Sequence
  Description of Artificial Sequence: Synthetic primer
gaagcatttcaatactttaactg

SEQ ID NO: 570 - DNA, 20 bp, Artificial Sequence
  Description of Artificial Sequence: Synthetic primer
ccactccagtgcacccaatc

SEQ ID NO: 571 - DNA, 20 bp, Artificial Sequence
  Description of Artificial Sequence: Synthetic primer
cttctcctggccactctgac

SEQ ID NO: 572 - DNA, 21 bp, Artificial Sequence
  Description of Artificial Sequence: Synthetic primer
ggtttacctttgaatcccagc

SEQ ID NO: 573 - DNA, 22 bp, Artificial Sequence
  Description of Artificial Sequence: Synthetic primer
tgaggatgaatgagcacatagg

SEQ ID NO: 574 - DNA, 21 bp, Artificial Sequence
  Description of Artificial Sequence: Synthetic primer
tttgtggtccattgagtaggc

SEQ ID NO: 575 - DNA, 20 bp, Artificial Sequence
  Description of Artificial Sequence: Synthetic primer
aggggaaggaatgtgcttgg

SEQ ID NO: 576 - DNA, 20 bp, Artificial Sequence
  Description of Artificial Sequence: Synthetic primer
ttcggctgagcgggcagtgt

SEQ ID NO: 577 - DNA, 30 bp, Artificial Sequence
  Description of Artificial Sequence: Synthetic primer
attgaaggtcctccaaaagaatgctgcagc

SEQ ID NO: 578 - DNA, 30 bp, Artificial Sequence
  Description of Artificial Sequence: Synthetic primer
agaacgtcaacatatctttttgggggacac

SEQ ID NO: 579 - DNA, 22 bp, Artificial Sequence
  Description of Artificial Sequence: Synthetic primer
ttgtatttgaggactttgctcg

SEQ ID NO: 580 - DNA, 20 bp, Artificial Sequence
  Description of Artificial Sequence: Synthetic primer
cggtaccatcctcctcttcc

SEQ ID NO: 581 - DNA, 20 bp, Artificial Sequence
  Description of Artificial Sequence: Synthetic primer
tttttgcctcatctatgccc

SEQ ID NO: 582 - DNA, 20 bp, Artificial Sequence
  Description of Artificial Sequence: Synthetic primer
gggtgacagagcaagactcc

SEQ ID NO: 583 - DNA, 18 bp, Artificial Sequence
  Description of Artificial Sequence: Synthetic primer
ttgctcaagttctcctgg

SEQ ID NO: 584 - DNA, 18 bp, Artificial Sequence
  Description of Artificial Sequence: Synthetic primer
accttgttttgaggggag

SEQ ID NO: 585 - DNA, 18 bp, Artificial Sequence
  Description of Artificial Sequence: Synthetic primer
cttggctatttggacagc

SEQ ID NO: 586 - DNA, 18 bp, Artificial Sequence
  Description of Artificial Sequence: Synthetic primer
gggcatttactcacttgc

SEQ ID NO: 587 - DNA, 19 bp, Artificial Sequence
  Description of Artificial Sequence: Synthetic primer
cttgtgtcagttgtcaggg

SEQ ID NO: 588 - DNA, 19 bp, Artificial Sequence
  Description of Artificial Sequence: Synthetic primer
tggaattgttgtgtcttgg

SEQ ID NO: 589 - DNA, 18 bp, Artificial Sequence
  Description of Artificial Sequence: Synthetic primer
ccagttccactggatgtt

SEQ ID NO: 590 - DNA, 18 bp, Artificial Sequence
  Description of Artificial Sequence: Synthetic primer
atgggctgtgtttctcaa

SEQ ID NO: 591 - DNA, 18 bp, Artificial Sequence
  Description of Artificial Sequence: Synthetic primer
ctgcctatccctggactt

SEQ ID NO: 592 - DNA, 18 bp, Artificial Sequence
  Description of Artificial Sequence: Synthetic primer
agtttgtccctagtgccc

SEQ ID NO: 593 - DNA, 19 bp, Artificial Sequence
  Description of Artificial Sequence: Synthetic primer
caacacgtctgacatccat

SEQ ID NO: 594 - DNA, 16 bp, Artificial Sequence
  Description of Artificial Sequence: Synthetic primer
ggatagtgcacaccca

SEQ ID NO: 595 - DNA, 22 bp, Artificial Sequence
  Description of Artificial Sequence: Synthetic primer
tgggtggtactattgttcccat

SEQ ID NO: 596 - DNA, 20 bp, Artificial Sequence
  Description of Artificial Sequence: Synthetic primer
agttccagcccccttaccag

SEQ ID NO: 597 - DNA, 20 bp, Artificial Sequence
  Description of Artificial Sequence: Synthetic primer
ggccactatcatccctgtgt

SEQ ID NO: 598 - DNA, 20 bp, Artificial Sequence
  Description of Artificial Sequence: Synthetic primer
tttcacatgggaagaacacg

SEQ ID NO: 599 - DNA, 20 bp, Artificial Sequence
  Description of Artificial Sequence: Synthetic primer
acagtgacactagggacggg

SEQ ID NO: 600 - DNA, 20 bp, Artificial Sequence
  Description of Artificial Sequence: Synthetic primer
tgccaggatggagataacaa

SEQ ID NO: 601 - DNA, 20 bp, Artificial Sequence
  Description of Artificial Sequence: Synthetic primer
cctgtggcacacatatcacc

SEQ ID NO: 602 - DNA, 20 bp, Artificial Sequence
  Description of Artificial Sequence: Synthetic primer
acaaccaagaatggagccac

SEQ ID NO: 603 - DNA, 20 bp, Artificial Sequence
  Description of Artificial Sequence: Synthetic primer
tgctgtgtaacaagtcccca

SEQ ID NO: 604 - DNA, 20 bp, Artificial Sequence
  Description of Artificial Sequence: Synthetic primer
tgaacggaggacctaccaag

SEQ ID NO: 605 - DNA, 20 bp, Artificial Sequence
  Description of Artificial Sequence: Synthetic primer
gcagggtccgactcactaag

SEQ ID NO: 606 - DNA, 20 bp, Artificial Sequence
  Description of Artificial Sequence: Synthetic primer
gctgtgagttccctttacgc

SEQ ID NO: 607 - DNA, 20 bp, Artificial Sequence
  Description of Artificial Sequence: Synthetic primer
acagtggggacaaagacagg

SEQ ID NO: 608 - DNA, 20 bp, Artificial Sequence
  Description of Artificial Sequence: Synthetic primer
tacagggcacctcccagtag

SEQ ID NO: 609 - DNA, 21 bp, Artificial Sequence
  Description of Artificial Sequence: Synthetic primer
tcttctgttaaggtttccccc

SEQ ID NO: 610 - DNA, 20 bp, Artificial Sequence
  Description of Artificial Sequence: Synthetic primer
tgtctcaaacctccctctgc

SEQ ID NO: 611 - DNA, 20 bp, Artificial Sequence
  Description of Artificial Sequence: Synthetic primer
aacatatttcctccccagcc

SEQ ID NO: 612 - DNA, 20 bp, Artificial Sequence
  Description of Artificial Sequence: Synthetic primer
cagtcccagccaatgagaac

SEQ ID NO: 613 - DNA, 20 bp, Artificial Sequence
  Description of Artificial Sequence: Synthetic primer
ctcctctgcatgggagaatc

SEQ ID NO: 614 - DNA, 20 bp, Artificial Sequence
  Description of Artificial Sequence: Synthetic primer
agacctgggaccagtctgtg

SEQ ID NO: 615 - DNA, 20 bp, Artificial Sequence
  Description of Artificial Sequence: Synthetic primer
gggagacgacgtcacaagat

SEQ ID NO: 616 - DNA, 20 bp, Artificial Sequence
  Description of Artificial Sequence: Synthetic primer
tgatgttgggaagatggtga

SEQ ID NO: 617 - DNA, 20 bp, Artificial Sequence
  Description of Artificial Sequence: Synthetic primer
caggcatcttctatgtgcca

SEQ ID NO: 618 - DNA, 20 bp, Artificial Sequence
  Description of Artificial Sequence: Synthetic primer
gggaggcacaagttctttca

SEQ ID NO: 619 - DNA, 20 bp, Artificial Sequence
  Description of Artificial Sequence: Synthetic primer
acttcgtggcactgagtgtg

SEQ ID NO: 620 - DNA, 20 bp, Artificial Sequence
  Description of Artificial Sequence: Synthetic primer
cctttcttacggatgaggca

SEQ ID NO: 621 - DNA, 20 bp, Artificial Sequence
  Description of Artificial Sequence: Synthetic primer
ggctgctgagctcttctgat

SEQ ID NO: 622 - DNA, 20 bp, Artificial Sequence
  Description of Artificial Sequence: Synthetic primer
tgggtctctctgcctgactt

SEQ ID NO: 623 - DNA, 20 bp, Artificial Sequence
  Description of Artificial Sequence: Synthetic primer
tcacctacttccagcttccg

SEQ ID NO: 624 - DNA, 20 bp, Artificial Sequence
  Description of Artificial Sequence: Synthetic primer
agacctgggaccagtctgtg

SEQ ID NO: 625 - DNA, 20 bp, Artificial Sequence
  Description of Artificial Sequence: Synthetic primer
ctcctctgcatgggagaatc

SEQ ID NO: 626 - DNA, 20 bp, Artificial Sequence
  Description of Artificial Sequence: Synthetic primer
aattcaggagacctgggacc

SEQ ID NO: 627 - DNA, 15 bp, Artificial Sequence
  Description of Artificial Sequence: Synthetic oligonucleotide
gtcttcaccacgggg

SEQ ID NO: 628 - DNA, 11 bp, Artificial Sequence
  Description of Artificial Sequence: Synthetic oligonucleotide
gtggtgaagac

SEQ ID NO: 629 - DNA, 18 bp, Artificial Sequence
  Description of Artificial Sequence: Synthetic primer
ccaagttctgagaagtcc

SEQ ID NO: 630 - DNA, 20 bp, Artificial Sequence
  Description of Artificial Sequence: Synthetic primer
aatacctgaaaccatacctg

SEQ ID NO: 631 - DNA, 17 bp, Artificial Sequence
  Description of Artificial Sequence: Synthetic oligonucleotide
agactggggtgagacgc

SEQ ID NO: 632 - DNA, 19 bp, Artificial Sequence
  Description of Artificial Sequence: Synthetic oligonucleotide
cagactgggttgagacgcc

SEQ ID NO: 633 - DNA, 24 bp, Artificial Sequence
  Description of Artificial Sequence: Synthetic primer
cccgtgtgctccgccgcccagttc

SEQ ID NO: 634 - DNA, 25 bp, Artificial Sequence
  Description of Artificial Sequence: Synthetic primer
ggctcacggagctcatcatggactt

SEQ ID NO: 635 - DNA, 502 bp, Homo sapiens
cccgtgtgctccgccgcccagttcccctgcgcgcggggtcagtgtgtggacctgcgcctgcgctgcgacggcgaggcagactgtcaggaccgctcagacgaggtggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcc

SEQ ID NO: 636 - DNA, 21 bp, Artificial Sequence
  Description of Artificial Sequence: Synthetic primer
agcgaggccaccatccacagg

SEQ ID NO: 637 - DNA, 21 bp, Artificial Sequence
  Description of Artificial Sequence: Synthetic primer
tcgctggtcggcataatcaat

SEQ ID NO: 638 - DNA, 501 bp, Mus sp.
agcagagccaccatccacaggatctccctggagactaacaacaacgatgtggctatcccactcacgggtgtcaaagaggcctctgcactggactttgatgtgtccaacaatcacatctactggactgatgttagcctcaagacgatcagccgagccttcatgaatgggagctcagtggagcacgtgattgagtttggcctcgactaccctgaaggaatggctgtggactggatgggcaagaacctctattgggcggacacagggaccaacaggattgaggtggcccggctggatgggcagttccggcaggtgcttgtgtggagagaccttgacaaccccaggtctctggctctggatcctactaaaggctacatctactggactgagtggggtggcaagccaaggattgtgcgggccttcatggatgggaccaattgtatgacactggtagacaaggtgggccgggccaacgacctcaccattgattatgccgaccagcga

SEQ ID NO: 639 - RNA, 25 nt, Artificial Sequence
  Description of Artificial Sequence: Synthetic oligonucleotide
aguacagcuucuugccaacccaguc

SEQ ID NO: 640 - RNA, 25 nt, Artificial Sequence
  Description of Artificial Sequence: Synthetic oligonucleotide
uccuccaggucgauggucagcccau

SEQ ID NO: 641 - RNA, 25 nt, Artificial Sequence
  Description of Artificial Sequence: Synthetic oligonucleotide
gucugaguccgaguucaaauccagg

SEQ ID NO: 642 - DNA, 3081 bp, Homo sapiens
cccgccagcccagcccagcccaaccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccttgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgcccacagatgtgaaatgaatgtaatctaatagaagcctaatcagcccaccatgttctccactgaaaaatcctctttctttggggtttttctttctttcttttttgattttgcactggacggtgacgtcagcctgtacaggctcccaggggtggcgtcaaatgctattgaaattgcgctgaatcgtatgctttttccttttgataaataaacaatgtaaaaatgtttcaaaaacctaataaaataaataaatacg

SEQ ID NO: 643 - DNA, 1324 bp, Homo sapiens
  modified_base (23)..(23): a, c, g, t, unknown or other
  modified_base (42)..(42): a, c, g, t, unknown or other
ggccgcccggcgcccccagcagnccgagccggggcgcacagncggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacagggaggttgggaggggggacagaggggagacagaggcacggagagaaaggaatgtttagcacaagacacagcggagctcgggattggctaatctcccatagtatttatggtggcgccggcggggccccagcccagcttgcaggccacctctagctttcttcctaccccattccggcttccctcctcctcccctgcagcctggttaggtggatacctgccctgacatgtgaggcaagctaaggcctggagggtcagatgggagaccaggtcccaagggagcaagacctgcgaagcgcagcagccccggcccttcccccgttttgaacatgtgtaaccgacagtctgccctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtact

SEQ ID NO: 644 - DNA, 2377 bp, Homo sapiens
ggtgacaaagagccaacagagacaataggagacttgtcaatttgtcttgatgggctacagttagagtctgaagttgttaccaatggtgaaactacatgttcagaaagtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttaaaaaaaaaaaaaaaaaaa

SEQ ID NO: 645 - DNA, 1295 bp, Homo sapiens
gggccgccgcccacccgggccttgcctctacctcagtcgttgccccccgattttcggctggagcccacggccccggccctcagcccccgctctagcttcgccagtagctcggccagcgacgcgagcaagccgtccagcccccggggcagcctgctgctggacggggcgggggctggcggagctggaggtagccggccctgcagcaatcgcaccagcggcatcagcatgggctacgaccagcgccacgggagccccttgccagcggggccgtgcctgtttggcccacccctggccggagcaccggcaggctattctcccggaggggtcccgtccgcctacccggagctccacgccgccctggaccgattgtacgctcagcggcccgcggggttcggctgccaggaaagccgccactcgtatcccccggccctgggcagccctggagctctagccggggcccgagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctcggggattgagccgtcgggtctggaggagccaccaggtcctttcgttccggaggccgcccgggcccggatgcgggagccagaggccagggaggactacttcggcacctgtatcaagtgcaacaaaggcatctatgggcagagcaatgcctgccaggccctggacagcctctaccacacccagtgctttgtttgctgctcttgtgggcgaactttgcgttgcaaggctttctacagtgtcaatggctctgtgtactgtgaggaagattatctgttttcagggtttcaggaggcagctgagaaatgctgtgtctgtggtcacttgattttggagaagatcctacaagcaatggggaagtcctatcatccaggctgtttccgatgcattgtttgcaacaagtgcctggatggcatccccttcacagtggacttctccaaccaagtatactgtgtcaccgactaccacaaaaattatgctcctaagtgtgcagcctgtggccaacccatcctcccctctgagggctgtgaggacatcgtgagggtgatatccatggaccgggattatcactttgagtgctaccactgtgaggactgccggatgcagctgagtgatgaggaaggctgctgctgtttccctctggatgggcacttgctctgccatggttg

SEQ ID NO: 646 - DNA, 3411 bp, Homo sapiens
gggcccggggtcccgccaccaccgcgcgcgggacagattgattcactttggagctgtaagtactgatgtattagggtgcagcgctcattgttcattgacgcagagtcccaaaatgaatatccaagagcagggtttccccttggacctcggagcaagtttcaccgaagatgctccccgacccccagtgcctggtgaggagggagaactggtgtccacagacccgaggcccgccagctacagtttctgctccgggaaaggtgttggcattaaaggtgagacttcgacggccactccgaggcgctcggatctggacctggggtatgagcctgagggcagtgcctcccccaccccaccatacttgaagtgggctgagtcactgcattccctgctggatgaccaagatgggataagcctgttcaggactttcctgaagcaggagggctgtgccgacttgctggacttctggtttgcctgcactggcttcaggaagctggagccctgtgactcgaacgaggagaagaggctgaagctggcgagagccatctaccgaaagtacattcttgataacaatggcatcgtgtcccggcagaccaagccagccaccaagagcttcataaagggctgcatcatgaagcagctgatcgatcctgccatgtttgaccaggcccagaccgaaatccaggccactatggaggaaaacacctatccctccttccttaagtctgatatttatttggaatatacgaggacaggctcggagagccccaaagtctgtagtgaccagagctctgggtcagggacagggaagggcatatctggatacctgccgaccttaaatgaagatgaggaatggaagtgtgaccaggacatggacgaggacgatggcagagacgctgctccccccggaagactccctcagaagctgctcctggagacagctgccccgagggtctcctccagtagacggtacagcgaaggcagagagttcaggtatggatcctggcgggagccagtcaacccctattatgtcaatgccggctatgccctggccccagccaccagtgccaacgacagcgagcagcagagcctgtccagcgatgcagacaccctgtccctcacggacagcagcgtggatgggatccccccatacaggatccgtaagcagcaccgcagggagatgcaggagagcgcgcaggtcaatgggcgggtgcccctacctcacattccccgcacgtaccgggtgccgaaggaggtccgcgtggagcctcagaagttcgcggaggagctcatccaccgcctggaggctgtgcagcgcacgcgggaggccgaggagaagctggaggagcggctgaagcgcgtgcgcatggaggaggaaggtgaggacggcgatccatcgtcagggcccccagggccgtgtcacaagctgcctcccgcccccgcttggcaccacttcccgccccgcttgtgttggacatgggcttgtgccgggctccgggatgcacacgaggagaaccctgagagcatcctggacgagcacgtacagcgtgtgctgaggacaactggccgccagtcgcctgggcctggccatcgctccccggacagtgggcacgtggccaagatgccagtggcactggggggtgccgcctcggggcacgggaagcacgtacccaagtcaggggcgaagctggacgcggccggcctgcaccaccaccgacacgtccaccaccacgtccaccacagcacagcccggcccaaggagcaggtggaggccgaggccacccgcagggcccagagcagcttcgcctggggcctggaaccacacagccatggggcaaggtcccgaggctactcagagagtgttggcgctgcccccaacgccagtgatggcctcgcccacagtgggaaggtgggcgttgcgtgcaaaagaaatgccaagaaggctgagtcggggaagagcgccagcaccgaggtgccaggtgcctcggaggatgcggagaagaaccagaaaatcatgcagtggatcattgagggggaaaaggagatcagcaggcaccgcaggaccggccacgggtcttcggggacgaggaagccacagccccatgagaactccagaccyttgtcccttgagcacccctgggccggccctcagctccggacctccgtgcagccctcccacctcttcatccaagaccccaccatgccaccccacccagctcccaaccccctaacccagctggaggaggcgcgccgacgtctggaggaggaagaaaagagagccagccgagcaccctccaagcagaggtatgtgcaggaggttatgcggcggggacgcgcctgcgtcaggccagcgtgcgcgccggtgctgcacgtggtaccagccgtgtcggacatggagctctccgagacagagacaagatcgcagaggaaggtgggcggcgggagtgcccagccgtgtgacagcatcgttgtggcgtactacttctgcggggaacccatcccctaccgcaccctggtgaggggccgcgctgtcaccctgggccagttcaaggagctgctgaccaaaaagggcagctacagatactacttcaagaaagtgagcgacgagtttgactgtggggtggtgtttgaggaggttcgagaggacgaggccgtcctgcccgtctttgaggagaagatcatcggcaaagtggagaaggtggactgataggctggtgggctggccgctgtgccaggcgaggcccttggcgggcacgggtgtcacggccaggcagatgacctcgtactcaggagcccgatggggaacagtgttgggtgtaccacccatccctgtggtctacccgtgtctagaggcaggtagggggtccctccaagtggtccacaagcttctgtcctgcccccaaggaggcagcctggaccactcctcatagcaatacttggagggcccagcccaagtgaggcagccgaggtccctgctgccagcttcaggtgacccccccccatcccccggcacctcccttgggcacgtgtgctgggatctactttccctctgggatttgcccacgtacccaggtctggctggggcccaggcccggatgcagaggcctgcagggcctctgtcaattgtacgcgccaccaagtgccttcaacacagcttgtctcttgcctgccactgtgtgaatcggcgacggagcactgcacctgcctccagccgccggctgtgcagtcctgggtcctcctttctgagggcccgtgtaaatatgtacatttctcaggctagggccagcaggggctgcccgagtctgtttttcatgcgatgacacttgtacaattatcttttcaaaggtacttggataataatgaaataaaactgtttttgaacctgaataaaaaaaaaaaaaaaaaaaaaaaaaa

SEQ ID NO: 647 - DNA, 3140 bp, Homo sapiens
ggctgcgagtacctccatggtcccggtggctgtgacggcggcagtggcgcctgtcctgtccataaacagcgatttctcagatttgcgggaaattaaaaagcaactgctgcttattgcgggccttacccgggagcggggcctactacacagtagcaaatggtcggcggagttggctttctctctccctgcattgcctctggccgagctgcaaccgcctccgcctattacagaggaagatgcccaggatatggatgcctataccctggccaaggcctactttgacgttaaagagtatgatcgggcagcacatttcctgcatggctgcaatagcaagaaagcctattttctgtatatgtattccagatatctgtctggagaaaaaaagaaggacgatgaaacagttgatagcttaggccccctggaaaaaggacaagtgaaaaatgaggcgcttagagaattgagagtggagctcagcaaaaaacaccaagctcgagaacttgatggatttggactttatctgtatggtgtggtgcttcgaaaactggacttggttaaagaggccattgatgtgtttgtggaagctactcatgttttgcccttgcattggggagcctggttagaactctgtaacctgatcacagacaaagagatgctgaagttcctgtctttgccagacacctggatgaaagagttttttctggctcatatatacacagagttgcagttgatagaggaggccctgcaaaagtatcagaatctcattgatgtgggcttctctaagagctcgtatattgtttcccaaattgcagttgcctatcacaatatcagagatattgacaaagccctctccatttttaatgagctaaggaaacaagacccttacaggattgaaaatatggacacattctccaaccttctttatgtcaggagcatgaaatcggagttgagttatctggctcataacctctgtgagattgataaataccgtgtagaaacgtgctgtgtaattggcaattattacagtttacgttctcagcatgagaaagcagccttatatttccagagagccctgaaattaaatcctcggtatcttggtgcctggacactaatgggacatgagtacatggagatgaagaacacgtctgctgctatccaggcttatagacatgccattgaggtcaacaaacgggactacagagcttggtatggcctcgggcagacctatgaaatccttaagatgccattttactgcctttattattatagacgggcccaccagcttcgacccaatgattctcgcatgctggttgctttaggagaatgttacgagaaactcaatcaactagtggaagccaaaaagtgttattggagagcttacgccgtgggagatgtggagaaaatggctctggtgaaactggcaaagcttcatgaacagttgactgagtcagaacaggctgcccagtgttacatcaaatatatccaagatatctattcctgtggggaaatagtagaacacttggaggaaagcactgcctttcgctatctggcccagtactattttaagtgcaaactgtgggatgaagcttcaacttgtgcacaaaagtgttgtgcatttaatgatacccgggaagaaggtaaggccttactccggcaaatcctacagcttcggaaccaaggcgagactcctaccaccgaggtgcctgctccctttttcctacctgcttcactctctgctaacaatacccccacacgcagagtttctccactcaacttgtcttctgtcacgccatagttggctactctcaagccagcacattgttagacccatcttaattaagccttacctccatgtaaagaacagcacgtctgttccaaggacctcagctcttcttgtttctacagatggcaacagctccatagggacagcttgtataattaccttcagaggccaactgacagaatcctggcaggaacagacattatcttgccagttagaagtacttctgtctcacttatgtccaaagagtggctatagatcttggccttcttccctgaatgctttttttttttggcccccaagaaagtcccttttatagcactttagcacaggcaatgctacaggaacaaagtttcaatgctgctgagagtgaaagaaaggaggaaagtctgccactctaccctgagctggcagtagggcactgagtacccttaggaagaagtcagagcaatggatacaaatgaccttgctcttggatttgctgagcatgatccctattctgatgtcagagattaggtttaaatggaatagagctatccatttgttcttactctctagggagacaatcttccaaaacagttttgggggggtcttctaaagctttcaaattggaagtaactttattcaactagagttgaataaaagaagggcaaaaataatctcacagagcttggaactgctgatagcccttactgagggcaaaagatggctatattgttagctatactcctaccaaagcaagcaaggagataggattatagataatttcacggacatttggaaataacattggtgattatacagacaagaataaactcacttcaagctggtctgttttaataaattttcaacgtaattgtctatttttttccctcccatctgcaacagaatacatttttttcagcctttatctagatgaggtaaagggaatcattcttatggtgctcttggagagtttcaggcctgtgcatgtgtgtacagcaggaggtaatatgctataatgtctgctgtaatatatttgcacagtagatgctatggatcattctgagctcagggtccagactttattcttattcccagaattttgtgttacgtttttacctcctaacatatgacacttcatcttatattaaggaaggtttagaatatctaatacgacttgaattcatttgttactaagccttctcaggcaagctgtatactagttactggtctccactgccatgccttttcaaggttcccatggtccagaatgatgtttgattcttaatttttctgtcccttttataatttgttttaatgattttgctacatttggaattcaataaaaaatgtgaacaataataaaaaaaaaaaaaaaaaa

SEQ ID NO: 648 - DNA, 3513 bp, Homo sapiens
ccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcctagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatttgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 649 - DNA, 3597 bp, Homo sapiens
catgccagttacttcctcaggaaaatattttcttgccttcttctttcagtatggttttaaatttgggaacagtggataacccaagtgtcccacaggccaaggtatattccaatggcagcatgatccctgcacccaaagccagcccctaaagcctaccccttgtgcacccgcagcctggtaagtgagcttggctgcttgtgaggagctacaagtgaaagagaagttattttaaataaatcccaaagtttgaggcagactgtccaggactgttcccaggaagaagcaggagttacccacaggaaaagtctctgacctggtcccctcaggcccagctacctgcgcccaccagcagtgaaggttgatgtactggcccagcatctccacctcccccatgcaaccaggtccctggtaccgtgtctcccgttgcatgtctggcttctgcctgtgctcctcctgccacgagcatcctccctgtccctcctcattccaccgtgtctctcctgcacacatagcctctgtcccagggcgatttatccacttgagtacaggagctgctcagacctctcagcccagccctctgtgactgccccagccccatcctaccccacccaaagctgccttcctggctgtaggagctccctcgtctagccaaggccctatgggtccccatccgaggatccacaagcaatgacttcccaaatgacctccactgcaagaagaatccttaccactgtttccagagccgtgaacgatgctgtgatggcccaggtctcagcaccaccctctgtgacctaaaaagaaaagctcaatttccatctgtcttctttcccaggaccaaggggacacagtaatgtgaagtcaaatacttaaccgagcaaagggccagtgttgttatcagtcaaggacaaacctcccacctcacagacagccaagcagtgagggaaagacagacagacataggtaggaaggtgctctgcaggcacaaggcccagagaagcccctctccgggaacttcccctgctccttccaggaacagtgagcccagtgagcagtcccagccagctcttcaaggccttcaaggggtctttccatgactgagtcacctccaggagctcacctgacccccagagaagacctaccccaggcagctccgtgccctggcttctccccatgccccaaatcccccccagccatccctcctggtcctcgtctacatcaagggcctcttcccctcttcctcccagctctcaggacaggtgactgggagaccttgaaccctcagcctcttcctttaaaaaaaacaaaacaaaacaaaactgtgggccatttatttgggattttggagttgtttggtttttgtttttatatcttaatagttcgaaagtaagaagggagccctgctatggatgttaagtccaaattactcggttagtgggagcaaaacctatgacttccaaggggatgaggagaggttcagaggacaggaggagcctcccccattgaaaaaaaaaaaatgggtcaggacattccctggatgaggacaatgctaggggtggcatctcacatggctgctgctattcctggtgcttccccacacttttgacagatggagtccttctcctaccgcctcctgccacctcaccctacaggcattctctatgtaggaaacaagagccttatcttatagagtggggagctgagacacagcctcaggtaacactgacacagctcccgaatgaggctgggacactctgcaaacctctcctcatggtgctaagggtggcatgctcttgacaggaaacctaaatgaccactcctctcatttggaaagtaatccactgcagtaaaagtttcagacatgcaagagagagtttttttttttttttactacaaatttttgctcccccataaaattatttttttattagagggagtatccaagttttaaaagtatatagaattttttggttgtaagagaaatacatactcattaggatcccgattaaattccttgagtagactggtgcctaccagaaagcaaagcaaagttaaacaaaacgaaacaaaatccttcatatacaaaaagaactttctgtttgtattggcagaggtagtgaggtgattcaggtaggctgaaaatcctgggttgcgggagcctcactttattccattcccacccgctttgatgtctatgcttggctctctgggctgcccctggtactgccgaatcctacacatctcttatcagctttcctcaaactttaaggaggctctgtgagggatgggtcatgggaagacccaagctttccctccgccaggattgcaaaagcaagtagacttggtctatgcagctcttcttccaacaatttctttatttggaattagaacttcctttgttagtatctttgatcttttgactcaagcacattttggaagggctcccttacaaaagtagaatttaaaacagaggatacagttaaagagcaacccaaaggacgcttaagaaaccgagaccacttcaccgaacaggactaaggaacactttcgtgcacagaagtcagccgcaatccaggcacaggacgaagatgggatacacgtgctcatctgtctgtcctcctttcctctccctccccgacgttctagttagcttgttgacttgttaaaccttctgttcttaaaatgaaaagctagcttacctcaaagaatcttgtttccattcggaaaccaacgattttgtgttttagaatggacagccctcccctcaccactccctaccttggcctggtgtccttgagacatacggtctttgcttagtcgtgtgttggctgctttgagcaggaacgaggcctccaggccctgaggtgggaaggaaggattggatgccactgccctcctccccactttagcatgtaggggccagcccatctcttccagcagggtcctgctgagttaccatagcaaccagcaactccagggtaccacaacagacaatggctcagcgagccgacgtgtggggatgatgcaggggttttggcccagccagaggacccagagttgagcttcaaatgctagagaaggggagaaacaggatggaagggtggtttaaggaactggcaggggtctttgagtcacatagagaagccgttgaaggaggtagggcaggttatctctgttccagtcacccccttccagccccatcccacttctgtttcaaactaaagctcccacctcgaacattgaccctttgttagaacaaagcaaagcatatctttaaacaacagtgttaaaatgagcctcaaatgtatgtggatgagatctctaagaagagggtcttctggttttgatttttaaagaagagtatcctagtaaaatattaaaaaaaaattaaaaagtttttaaaaaggaaacctatgctatttaaattggagcccagttgtaacttggtaaaggcaagcttctgtacctttgttataattaattgtatacctgtgtatgtaaatataaggcattcctattttgcagttcagaacaaaaaaaacttatttgtaatatagaataaagtttattaaaaaataagaaaaaaaaaaaaaaaaaaaa

SEQ ID NO: 650 - DNA, 855 bp, Homo sapiens
cgctcaattatctactcgagtctagactcgaggcggccgcccattgtgcactaaagcaggggatagcaacggcgtccctcctccccgctcagctgcagcccgcagtcctcacagtggtaacatgccacgtggtagtctctgtccatggacaccacacggatggttgtctcgcagccctgtgcagggaggataggacgggcacaggaggcgcattttggtgcaaaaaccgtgtgatagtctcgcacgcagtagatgttgttctccacgtccacggtgaagggaaccccgtccaggcactcattgcacacggagcaccggaagcagcctgggtggtaggacttgcccagggcctgcaggatcatttccatgatgagatgtccacacacgctgcatttgtcggccgtctgctggaacccggagtacaggaagtcctcctggcagtacactttctcacccacgttgtagaacgccttcccacggagtcgtctcccacacgagtcgcaggtgaagcagtcagtgtgataaagactccccattgcctggcacgcctgctgggctccgtagatgccaagcccacacttgatgcaaatgccgaagtagtcccgcgccgtgcgcgcctcgagcgcccgctccagctcccgggtgagcgcctccagccgccgctcggccgcgcttgggccgccctcccggccagggggcagcgggagtgcaggcagcgggaagggggccggccccgcaggctccggggagcgagcgggcgcggggcaggcgccgggcgggaggaagtcagcgtaggctttagtgcacaatgggaattcggatccggtcgacactagttctaggatctcttttttt

SEQ ID NO: 651 - DNA, 3791 bp, Homo sapiens
acagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccacctctggaaaaagatcccccgcttgctcctcgctgaccccatcactgtgcaagctggggctgcaggaaggcagcaacaactcgtctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattgtggagtttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgaatcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacattcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatgcgtaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagaatgagaagatcctagaacagatagacaagagtggcgagctcataagccttagagaggaggtgacccaccttacccgctcacttcggcgtgcggagacagagaccaaagtgctccaggaggcctggcaggccagctggactccaactgccagcctatggccaccaattggatccaggagaaagtgtggctctctcaggaggtggacaaactgagagtgatgttcctggagatgaaaaatgagaaggaaaactcctgatcaagttccagagcccatagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatttgtttcacctctttttacctgcaatacccccttaccccaataccaagaccaactggcatagagccaactgagataaatgctatttaaataaagtgtatttaatgaaaaaaaaaaaaaaaaaaaaa

SEQ ID NO: 652 - DNA, 1683 bp, Homo sapiens
ctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggcctgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcagtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatg

SEQ ID NO: 653 - DNA, 1696 bp, Homo sapiens
cacctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctgtggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 654 - DNA, 7680 bp, Homo sapiens
gaagagcaagaggcaggctcagcaaatggttcagccccagtccccggtggctgtcagtcaaagcaagcccggttgttatgacaatggaaaacactatcagataaatcaacagtgggagcggacctacctaggtaatgtgttggtttgtacttgttatggaggaagccgaggttttaactgcgaaagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggttgaagacacaaggaaataagcaaatgctttgcacgtgcctgggcaacggagtcagctgccaagagacagctgtaacccagacttacggtggcaacttaaatggagagccatgtgtcttaccattcacctacaatggcaggacgttctactcctgcaccacggaagggcgacaggacggacatctttggtgcagcacaacttcgaattatgagcaggaccagaaatactctttctgcacagaccacactgttttggttcagactcaaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcaacttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggccagcccaggcagtacaatgtgggtccctctgtctccaagtaccccctgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccatcgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaca

SEQ ID NO: 655 - DNA, 1316 bp, Homo sapiens
tcctaatacgactcactatagggctcgagcggccgcccgggcaggtcgaatgcaggcgacttgcgagctgggagcgatttaaaacgctttggattcccccggcctgggtggggagagcgagctgggtgccccctagattccccgcccccgcacctcatgagccgaccctcggctccatggagcccggcaattatgccaccttggatggagccaaggatatcgaaggcttgctgggagcgggaggggggcggaatctggtcgcccactcccctctgaccagccacccagcggcgcctacgctgatgcctgctgtcaactatgcccccttggatctgccaggctcggcggagccgccaaagcaatgccacccatgccctggggtgccccaggggacgtccccagctcccgtgccttatggttactttggaggcgggtactactcctgccgagtgtcccggagctcgctgaaaccctgtgcccaggcagccaccctggccgcgtaccccgcggagactcccacggccggggaagagtaccccagtcgccccactgagtttgccttctatccgggatatccgggaacctaccacgctatggccagttacctggacgtgtctgtggtgcagactctgggtgctcctggagaaccgcgacatgactccctgttgcctgtggacagttaccagtcttgggctctcgctggtggctggaacagccagatgtgttgccagggagaacagaacccaccaggtcccttttggaaggcagcatttgcagactccagcgggcagcaccctcctgacgcctgcgcctttcgtcgcggccgcaagaaacgcattccgtacagcaaggggcagttgcgggagctggagcgggagtatgcggctaacaagttcatcaccaaggacaagaggcgcaagatctcggcagccaccagcctctcggagcgccagattaccatctggtttcagaaccgccgggtcaaagagaagaaggttctcgccaaggtgaagaacagcgctaccccttaagagatctccttgcctgggtgggaggagcgaaagtgggggtgtcctggggagaccagaaacctgccaagcccaggctggggccaaggactctgctgagaggcccctagagacaacacccttcccaggccactggctgctggactgttcctcaggagcggcctgggtacccagtatgtgcagggagacggaaccccatgtgacaggcccactccaccagggttcccaaagaacctggcccagtcataatcattcatcctcacagtggcaataatcacgataaccagt

SEQ ID NO: 656 - DNA, 566 bp, Homo sapiens
cccaccaaacccataaagagggtgggtcgacccacgcgtccgcggacgcgtgggaaattattgaattggaaacagaaatagaaaagtttaaagctgagaacgcatctttagctaaacttcgcattgaacgagaaagtgccttggaaaaactcaggaaagaaattgcagacttcgaacaacagaaagcaaaagaattagctcgaatagaagagtttaaaaaggaggagatgaggaagctacaaaaggaacgtaaagtttttgaaaagtatactacagctgcaagaacttttccagataaaaaggaacgtgaagaaatacagactttaaaacagcaaatagcagatttacgggaagatttgaaaagaaaggagaccaaatggtcaagtacacacagccgtctcagaagccagatacaaatgttagtcagagagaacacagacctccgggaagaaataaaagtgatggaaagattccgactggatgcctggaagagagcagaagccatagagagcagcctcgaggtggagaagaaggacaagcttgcgaacacatctgttcgatttcaa

SEQ ID NO: 657 - DNA, 5067 bp, Homo sapiens
gcccggacacctgtctgcagcatggataagtatgacgacctgggcctggaggccagtaaattcatcgaggacctgaacatgtatgaggcctctaaggatgggctcttccgagtggacaagggtgcaggcaacaaccccgagtttgaggaaactcgcagggtgttcgccaccaagatggccaaaatccacctccagcagcagcagcagcagctcctgcaggaggagactctgcccagggggagtagaggccctgtcaatggagggggccgcctgggcccacaggcccgttgggaagttgtgggcagcaagctgactgtggatggtgctgccaagcctcctcttgctgcctcgacaggggcacctggggcagtcaccaccctcgctgctgggcagcccccgtacccaccgcaggagcagagatccaggccatacctgcatggcacgaggcatggcagccaggactgtggttccagggagagcctggcgacttctgagatgtctgctttccaccagccaggcccctgtgaggatccttcctgcctcactcatggagactattatgacaacctctccttggcaagcccaaagtggggtgacaaaccaggagtgtcccccagcatcggcctgagtgtagggagtgggtggcctagctccccggggagtgacccaccactgcccaaaccctgcggggaccatcccctaaatcaccgacagctctccctgagctccagcaggtcttctgagggtagcctcggtggtcagaatagtggcattggtggccgcagcagcgagaagccaacaggcctttggtccactgcctcctcccagcgggtgagccctggcctgccttccccaaacttggagaacggagcaccagctgtggggcctgttcagcccaggactccttctgtgtcagcacccttggccctgagctgccccaggcaaggaggtcttccaagatcaaactcggggctggggggtgaggtttcaggtgtgatgtccaaacccaatgtggacccccaaccctggttccaggatgggcccaaatcttacctttccagttctgccccgtcatcctcgccagctggcctggacggttcacagcagggtgcggtccctgggctggggccgaagcctggctgcacagaccttggcactggtcccaagctcagccccaccagtcttgtccatccagtgatgtccaccctgcctgagttatcttgtaaagagggtcccctgggctggtcttctgatggtagcctgggatctgtgctcctggacagccccagctcccctagggtaaggctgccctgccagcccctcgtcccaggtcctgagctgagaccctctgctgctgagttgaaattagaagccctcacccaacgtctggagcgagagatggatgctcacccgaaggctgattactttggagcctgtgtgaaatgcagcaaaggggtgtttggggctggccaggcctgtcaggccatggggaacctctaccatgacacatgcttcacctgtgcagcttgcagccggaagctgagaggaaaagccttttattttgtcaacggcaaagtgttttgtgaagaagacttcctgtactctggtttccagcagtcggctgacaggtgttttctttgtggacatctgatcatggacatgatcctgcaagccctggggaagtcctaccaccccggctgtttccgctgtgtcatctgtaatgagtgtttggatggggtgcccttcaccgtggactcagagaacaagatctactgtgtccgagattaccacaaggtgctggcccccaagtgtgcagcctgtgggcttcccatccttccacctgagggctcagatgagaccatccgtgtcgtgtccatggacagagactaccacgtggagtgttaccactgcgaggactgtggtctggagctcaatgatgaagatggccaccgctgttatccgctggaggaccacctgttctgtcactcctgccacgtgaagaggctggagaagagaccctcatctacagcccttcaccagcaccacttctagccagagccacttgcagacatcacggcaggggatgaggagccggggttgctgctgctgcttccggtggcccctggggtggaagtggggtaggggaagaggaggggcaggagggagagttcctgtgagcatgtggggggtgcctttcctttaaccagggaggtgaacactacctgcctcctgcgtgtattttccaagtgcttttctctgttgccacattttcctcaggttactcaggaaaatgctccagcatgtgcgagcacatgacctgaggttgcatcatagcaccaaaggaatcctcctgtcccctctgggaacatttcatgcttcagagggagaggtttttattgagcttgtttcacaatatccccttgaagggacagctcagctgccaatacattcaaccctttctcttccttcaggaaaatacctatacccaaatgttccctcccccgacatatatcatggcatgacttaaggcttcttttcacctgagagcttcagttcttctgcagaatggctgcaaatttaattgcattaaggcaagaaggaagctctaatgtgtgctttgtatcctaagataaatttgcttagaaaaccagagtcaagatttgaaataggtgaggcagggtttcctccttagacactgacagcattctccgtaccccttcaaatccttactctcctaaaggcagctgagtccgcgacagaaatttgccctatgggagtaaaacatactttgggagaagaacttggtgcaggcaccaggatttttttttttgcccacgtgtttgcgctgtttttctctggagttctcaagagttggtgacttggaaggccgcttctgcaaggcaagtctcaggaacccatgcaggtacatcgcttgcacctgtttttagcttatttaatgacgggcttttgggaagagctgcccgcatactgagagacagcttcttataaacaaggagagtttttgtgtgtgcgagatctctaagccagcgtgggagggagcgcctcaggataagttattatattcatttcgttggtttctctcctgcccaattcttggcacaggcattatgtttgaagaaaccaggataaggtacactgcttttgtctgtttaatttttttagttgtttcccttcactttcagtcttccacacacaaaaaatacctcacagagcttcaccaaatcacagattcaggaggaatttggctttcacactggactcagataccttcttcagtgtgttggaaatcactggcttcacacaggcccaactccaactggtcagggcagagtgatcgtaactaaaggtcagtggggaatagatccgattcagtgcttttgccttatgcatttcagcatcctggctccccagggtggcaggagctgaggaagggccacacactggcaagatttcaagaccactctctgcactgaagaggtaaaatttgcactgcaagtcacatccctgaggccagaggtcagtaccctttggtatttcgattagaagaagctgcaaaagaaaggcagcccattttaccattgccagccaggccggggacacaggagccggtgtgtgcactctgcctcctaacattgcacccagagcaagaggactgggtgctgggctgcagaggccggtcagtggagcccctagcacgtgtgaactcaggcttttcattgggcccggctccacttctaggccatgttttgactcatttggtaaccattgcctgtaagcagcacagaattggtgccatggattatcttttccatgttgatggaattcattctgttggaatcctttggccagatgtcacttcagccagggtgtgcatcatcattggttctttttcacaggctgagcctcctgaaaacccatgaacgctggggctggggaagtgaaccctgaggtggggaccctctcttcccatcaaatcatccagctcagtgtggggcgtggcaggggggtaaatgaagccagccaatgtgttaacctgtctctgtcaacctaagaatgttggccttactgacacacctttgctccatgttcaagaccagaagtagctgggatttgtttgcaaattgggtaattagtttaaaaatctgtgattacatttttaaatgaaattttcaaagtggcctagattgaggtgattcagataggtttgcgaatataccattttatattgttgagaaagaacaaaaagggaatttccagatgtcctagaaatcctagcaacagatttctctggttgtcagtttccctggagaaggcgccagataggaatctccaatcagttgtttttctcttcgcttcaggcccttacacaaaagccatgaagagatgttcacctacccggtattttaaatgttctgtaaattattagccaaatagaactgtaatggggttgtatttatgggcgcctagaaagaaaacacaaggacttggtaggccaggaagaaaagattttaaaatttagaatgaatagcccttctgggttttctttttgacaattcttggacttgaggtaaaacaaggaggattgtggccggatttcagatcccaaagccagcctccatcttaggcctttgcctcattgtgccttttaggttttcttacccaccgtctcctgttttgtcttttttttcttttctcctacccctatcttgggacattcagaaactgcctgggtggtttgagaagagacaacccagtttgatctgcaatacaaggatccattcgtaatctctctctcactgatgttattcccccatctgccgtcttggttcatctcaccacagaagggcatttagtcctacccagccatcggctgcggtatgacagcaggatggcacttcccatttctctgtggttagtgctcgagtgaaaacctctttcagctgagtcctctgaggttctgctgttgagtcctgggtggctgatggaatgattgaggaggtctggtcaccctcaagcgccgtcatcgccttgtttccatgggcttct

SEQ ID NO: 658 - DNA, 950 bp, Homo sapiens
tcgaccggatccgaattcccattgtgcactaaagcgtctccctgctccgcggcccgggctggcgggcgggcgctcggctggcggctgcagcagcagagggagacccgcggcaaccccggcaacccagggctcggcgtcgctgccaccatgacgggaagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgttcccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagctttagtgcacaatgggcggccgcctcgagtctagactcgagtagataattgagcggaatttctt

SEQ ID NO: 659 - DNA, 2346 bp, Homo sapiens
ccgccgtcgcccccgcctccccctgcctcagcggctgcccccgccagcgggccgcccgctcccccgggccttgcagcgggccccggcccggctggaggggccccgaccccagctctggtggcgggcagcagcgccgcggcccccttccctcacggggactcggccctgaacgagcaggagaaggagttgcagcggcggctgaagcgtctctacccggccgtggacgaacaagagacgccgctgcctcggtcctggagcccgaaggacaagttcagctacatcggcctctctcagaacaacctgcgggtgcactacaaaggtcatggcaaaaccccaaaagatgccgcgtcagttcgagccacgcatccaataccagcagcctgtgggatttattattttgaagtaaaaattgtcagtaagggaagagatggttacatgggaattggtctttctgctcaaggtgtgaacatgaatagactaccaggttgggataagcattcatatggttaccatggggatgatggacattcgttttgttcttctggaactggacaaccttatggaccaactttcactactggtgatgtcattggctgttgtgttaatcttatcaacaatacctgcttttacaccaagaatggacatagtttaggtattgctttcactgacctaccgccaaatttgtatcctactgtggggcttcaaacaccaggagaagtggtcgatgccaattttgggcaacatcctttcgtgtttgatatagaagactatatgcgggagtggagaaccaaaatccaggcacagatagatcgatttcctatcggagatcgagaaggagaatggcagaccatgatacaaaaaatggtttcatcttatttagtccaccatgggtactgtgccacagcagaggcctttgccagatctacagaccagaccgttctagaagaattagcttccattaagaatagacaaagaattcagaaattggtattagcaggaagaatgggagaagccattgaaacaacacaacagttatacccaagtttacttgaaagaaatcctaatctccttttcacattaaaagtgcgtcagtttatagaaatggtgaatggtacagatagtgaagtacgatgtttgggaggccgaagtccaaagtctcaagacagttatcctgttagtcctcgaccttttagtagtccaagtatgagccccagccatggaatgaatatccacaatttagcatcaggcaaaggaagcaccgcacatttttcaggttttgaaagttgtagtaatggtgtaatatcaaataaagcacatcaatcatattgccatagtaataaacaccagtcatccaacttgaatgtaccagaactaaacagtataaatatgtcaagatcacagcaagttaataacttcaccagtaatgatgtagacatggaaacagatcactactccaatggagttggagaaacttcatccaatggtttcctaaatggtagctctaaacatgaccacgaaatggaagattgtgacaccgaaatggaagttgattcaagtcagttgagacgccagttgtgtggaggaagtcaggccgccatagaaagaatgatccactttggacgagagctgcaagcaatgagtgaacagctaaggagagactgtggcaagaacactgcaaacaaaaaaatgttgaaggatgcattcagtctactagcatattcagatccctggaacagcccagttggaaatcagcttgacccgattcagagagaacctgtgtgctcagctcttaacagtgcaatattagaaacccacaatctgccaaagcaacctccacttgccctagcaatgggacaggccacacaatgtctaggactgatggctcgatcaggaattggatcctgcgcatttgccacagtggaagactacctacattagctatgcatttcaagagctcacacttatattgtggcatatagtcaacatggaagtagaccagctctgctgatttgaaatttagattttttaaattatgtactggggacaggtttttgtcgctttacattgcttcctagtttacagcatgatgcaaatgattttctaacttagtgttaggagaaattattttccatctttaacctcttagttgtctaagagttaaatattactgaatttcagacgttcaaattgatcatcacaaatcctttaaaacaattacctaaaagaaaccaaaaatcctgccttctttgtgggggaggggggagagaggggaaggaaatggaacaagttgtgtttgtgttagcatgtgggtgatgtaaacttcaaattgggagatgttccgacccc

SEQ ID NO: 660 - DNA, 2512 bp, Homo sapiens
caatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataacaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggggatctgccatatttgtgttggtttttattttcatatccagcctaaaggtggttgtttattatatagtaataaatcattgctgtacaacatgctggtttctgtagggtatttttaattttgtcagaaattttagattgtgaatattttgtaaaaaacagtaagcaaaattttccagaattcccaaaatgaaccagataccccctagaaaattatactattgagaaatctatggggaggatatgagaaaataaattccttctaaaccacattggaactgacctgaagaagcaaactcggaaaatataataacatccctgaattcaggcattcacaagatgcagaacaaaatggataaaaggtatttcactggagaagttttaatttctaagtaaaatttaaatcctaacacttcactaatttataactaaaatttctcatcttcgtacttgatgctcacagaggaagaaaatgatgatggtttttattcctggcatccagagtgacagtgaacttaagcaaattaccctcctacccaattctatggaatattttatacgtctccttgtttaaaatctgactgctttactttgatgtatcatatttttaaataaaaataaatattcctttagaagatcactctaaaa

SEQ ID NO: 661 - DNA, 2306 bp, Homo sapiens
gggcgggagctgcacgcgccgtggctccggatctcttcgtctttgcagcgtacgcccgagtcggtcagcgccggaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgacccctacctctaccggcccgttgctgtggctctagacactaaaggacctgagatccgaactgggctcatcaagggcagcggcactgcagagctggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacc

SEQ ID NO: 662 - DNA, 2656 bp, Homo sapiens
gaattcgcggccgcagagtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagccttacaggaacaaaacataaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggaacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggtggcagcaccatggatagctccgcaggaagcaaggctaggcgtgaggctggggaggacgaggagggattcctttccaaacttaagaaaatgtttacctcatgatatcccagccgaggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggccccctggtcagcagaggagaggttagatcttgcaggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaagcacgttaaaggcccagagagatcctgggggttctgctctgaccgtgtgggtggtgatccttgtcaggatgtacagtccttgctcccaccccatccgggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgaaaaaaaaaaaaaaaaa

SEQ ID NO: 663 - DNA, 2217 bp, Homo sapiens
gcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 664 - DNA, 8906 bp, Homo sapiens
gaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcacgtgagaacaatctggcaacaccgcaaggtccggctgcatcagaggctgcagctgtgtgttttccagcaggaagttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaaatatcagctccttttaaaagagctgctgacgtgctgtgaggaaggaaagggagagattaaagatggcctggaggtgatgctcagcgtgccgaagcgagccaatgacgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggaccactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcagagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcatcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgccaaggacggaggtcgcattgctgtatcacagtattttttacggatttctg

SEQ ID NO: 665 - DNA, 1204 bp, Homo sapiens
tcggcggcggtggtatcggcggcagctgtgagggggttccgggaagatggtgctgatcaaggaattccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctataagctggtgaccatcaaattcaagtggtggggactgcaaagcaaagtagaaaacttcattcaaaagcaagaaaaacggatatttacaaacttccatcgccagcttttttgttggattgacaagtggatcgatctcacgatggaagacattaggagaatggaagacgagactcagaaagaactagaaacaatgcgtaagaggggttccgttcgaggcacgtcggctgctgatgtctagatgagtcccctgtagggtcagagacaatgtcaaactgtttacgtaatcaaggtcaagtgaggggaacaagcgcagccagtgatgagtgaacaacaatctgaccagtatcttgcagtgttgacgtttcccagatgtgtgcttgtgatgatacacacacatgcacaggttctcaaccacgtgtgtatatatgtatgtgtgcatatgtctgtagctgtatataaagcgcatgtagagctacagatccagatacacacacttgtgtatatatgtacatacagacatactgaagggattagtacaatttctccaaagtactgtacctatcttcagcaagaatgcaaa

SEQ ID NO: 666 - protein, 892 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 667 - protein, 197 aa, Homo sapiens
MMFPQSRHSGSSHLPQQLKFTTSDSCDRIKDEFQLLQAQYHSLKLECDKLASEKSEMQRHYVMYYEMSYGLNIEMHKQAEIVKRLNGICAQVLPYLSQEHQQQVLGAIERAKQVTAPELNSIIRQQLQAHQLSQLQALALPLTPLPVGLQPPSLPAVSAGTGLLSLSALGSQAHLSKEDKNGHDGDTHQEDDGEKSD

SEQ ID NO: 668 - protein, 739 aa, Homo sapiens
GDKEPTETIGDLSICLDGLQLESEVVTNGETTCSESASQNDDGSRSKDETRVSTNGSDDPEDAGAGENRRVSGNNSPSLSNGGFKPSRPPRPSRPPPPTPRRPASVNGSPSATSESDGSSTGSLPPTNTNTNTSEGATSGLIIPLTISGGSGPRPLNPVTQAPLPPGWEQRVDQHGRVYYVDHVEKRTTWDRPEPLPPGWERRVDNMGRIYYVDHFTRTTTWQRPTLESVRNYEQWQLQRSQLQGAMQQFNQRFIYGNQDLFATSQSKEFDPLGPLPPGWEKRTDSNGRVYFVNHNTRITQWEDPRSQGQLNEKPLPEGWEMRFTVDGIPYFVDHNRRTTTYIDPRTGKSALDNGPQIAYVRDFKAKVQYFRFWCQQLAMPQHIKITVTRKTLFEDSFQQIMSFSPQDLRRRLWVIFPGEEGLDYGGVAREWFFLLSHEVLNPMYCLFEYAGKDNYCLQINPASYINPDHLKYFRFIGRFIAMALFHGKFIDTGFSLPFYKRILNKPVGLKDLESIDPEFYNSLIWVKENNIEECDLEMYFSVDKEILGEIKSHDLKPNGGNILVTEENKEEYIRMVAEWRLSRGVEEQTQAFFEGFNEILPQQYLQYFDAKELEVLLCGMQEIDLNDWQRHAIYRHYARTSKQIMWFWQFVKEIDNEKRMRLLQFVTGTCRLPVGGFADLMGSNGPQKFCIEKVGKENWLPRSHTCFNRLDLPPYKSYEQLKEKLLFAIEETEGFGQE

SEQ ID NO: 669 - protein, 431 aa, Homo sapiens
GPPPTRALPLPQSLPPDFRLEPTAPALSPRSSFASSSASDASKPSSPRGSLLLDGAGAGGAGGSRPCSNRTSGISMGYDQRHGSPLPAGPCLFGPPLAGAPAGYSPGGVPSAYPELHAALDRLYAQRPAGFGCQESRHSYPPALGSPGALAGARVGAAGPLERRGAQPGRHSVTGYGDCAVGARYQDELTALLRLTVGTGGREAGARGEPSGIEPSGLEEPPGPFVPEAARARMREPEAREDYFGTCIKCNKGIYGQSNACQALDSLYHTQCFVCCSCGRTLRCKAFYSVNGSVYCEEDYLFSGFQEAAEKCCVCGHLILEKILQAMGKSYHPGCFRCIVCNKCLDGIPFTVDFSNQVYCVTDYHKNYAPKCAACGQPILPSEGCEDIVRVISMDRDYHFECYHCEDCRMQLSDEEGCCCFPLDGHLLCHG

SEQ ID NO: 670 - protein, 900 aa, Homo sapiens
GPGSRHHRARDRLIHFGAVSTDVLGCSAHCSLTQSPKMNIQEQGFPLDLGASFTEDAPRPPVPGEEGELVSTDPRPASYSFCSGKGVGIKGETSTATPRRSDLDLGYEPEGSASPTPPYLKWAESLHSLLDDQDGISLFRTFLKQEGCADLLDFWFACTGFRKLEPCDSNEEKRLKLARAIYRKYILDNNGIVSRQTKPATKSFIKGCIMKQLIDPAMFDQAQTEIQATMEENTYPSFLKSDIYLEYTRTGSESPKVCSDQSSGSGTGKGISGYLPTLNEDEEWKCDQDMDEDDGRDAAPPGRLPQKLLLETAAPRVSSSRRYSEGREFRYGSWREPVNPYYVNAGYALAPATSANDSEQQSLSSDADTLSLTDSSVDGIPPYRIRKQHRREMQESAQVNGRVPLPHIPRTYRVPKEVRVEPQKFAEELIHRLEAVQRTREAEEKLEERLKRVRMEEEGEDGDPSSGPPGPCHKLPPAPAWHHFPPRLCWTWACAGLRDAHEENPESILDEHVQRVLRTTGRQSPGPGHRSPDSGHVAKMPVALGGAASGHGKHVPKSGAKLDAAGLHHHRHVHHHVHHSTARPKEQVEAEATRRAQSSFAWGLEPHSHGARSRGYSESVGAAPNASDGLAHSGKVGVACKRNAKKAESGKSASTEVPGASEDAEKNQKIMQWIIEGEKEISRHRRTGHGSSGTRKPQPHENSRPLSLEHPWAGPQLRTSVQPSHLFIQDPTMPPHPAPNPLTQLEEARRRLEEEEKRASRAPSKQRYVQEVMRRGRACVRPACAPVLHVVPAVSDMELSETETRSQRKVGGGSAQPCDSIVVAYYFCGEPIPYRTLVRGRAVTLGQFKELLTKKGSYRYYFKKVSDEFDCGVVFEEVREDEAVLPVFEEKIIGKVEKVD

SEQ ID NO: 671 - protein, 591 aa, Homo sapiens
MVPVAVTAAVAPVLSINSDFSDLREIKKQLLLIAGLTRERGLLHSSKWSAELAFSLPALPLAELQPPPPITEEDAQDMDAYTLAKAYFDVKEYDRAAHFLHGCNSKKAYFLYMYSRYLSGEKKKDDETVDSLGPLEKGQVKNEALRELRVELSKKHQARELDGFGLYLYGVVLRKLDLVKEAIDVFVEATHVLPLHWGAWLELCNLITDKEMLKFLSLPDTWMKEFFLAHIYTELQLIEEALQKYQNLIDVGFSKSSYIVSQIAVAYHNIRDIDKALSIFNELRKQDPYRIENMDTFSNLLYVRSMKSELSYLAHNLCEIDKYRVETCCVIGNYYSLRSQHEKAALYFQRALKLNPRYLGAWTLMGHEYMEMKNTSAAIQAYRHAIEVNKRDYRAWYGLGQTYEILKMPFYCLYYYRRAHQLRPNDSRMLVALGECYEKLNQLVEAKKCYWRAYAVGDVEKMALVKLAKLHEQLTESEQAAQCYIKYIQDIYSCGEIVEHLEESTAFRYLAQYYFKCKLWDEASTCAQKCCAFNDTREEGKALLRQILQLRNQGETPTTEVPAPFFLPASLSANNTPTRRVSPLNLSSVTP

SEQ ID NO: 672 - protein, 914 aa, Homo sapiens
VYQVLLVGSTLLKEVPSGLQLEQLPSQSLLTHIPTAGLPTSLGGGLPYCHQAWLDFRRRLEALLQNCQAACALLQGAIESVKAVPQPMEPGEVGQLLQQTEVLMQQVLDSPWLAWLQCQGGRELTWLKQEVPEVTLSPDYRTAMDKADELYDRVDGLLHQLTLQSNQRIQALELVQTLEARESGLHQIEVWLQQVGWPALEEAGEPSLDMLLQAQGSFQELYQVAQEQVRQGEKFLQPLTGWEAAELDPPGARFLALRAQLTEFSRALAQRCQRLADAERLFQLFREALTWAEEGQRVLAELEQERPGVVLQQLQLHWTRHPDLPPAHFRKMWALATGLGSEAIRQECRWAWARCQDTWLALDQKLEASLKLPPVGSTASLCVSQVPAAPAHPPLRKAYSFDRNLGQSLSEPACHCHHAATIAACRRPEAGGGALPQASPTVPPPGSSDPRSLNRLQLVLAEMVATEREYVRALEYTMENYFPELDRPDVPQGLRGQRAHLFGNLEKLRDFHCHFFLRELEACTRHPPRVAYAFLRHRVQFGMYALYSKNKPRSDALMSSYGHTFFKDKQQALGDHLDLASYLLKPIQRMGKYALLLQELARACGGPTQELSALREAQSLVHFQLRHGNDLLAMDAIQGCDVNLKEQGQLVRQDEFVVRTGRHKSVRRIFLFEELLLFSKPRHGPTGVDTFAYKRSFKMADLGLTECCGNSNLRFEIWFRRRKARDTFVLQASSLAIKQAWTADISHLLWRQAVHNKEVRMAEMVSMGVGNKAFRDIAPSEEAINDRTVNYVLKCREVRSRASIAVAPFDHDSLYLGASNSLPGDPASCSVLGSLNLHLYRDPALLGLRCPLYPSFLEEAALEAEAELGGQPSLTAEDSEISSQCPSASGSSGSDSSCVSGQALGRGLEDLPCV

SEQ ID NO: 673 - protein, 277 aa, Homo sapiens [sequence omitted]

SEQ ID NO: 674 - protein, 1120 aa, Homo sapiens
MWRVKKLSLSLSPSPQTGKPSMRTPLRELTLQPGALTTSGKRSPACSSLTPSLCKLGLQEGSNNSSPVDFVNNKRTDLSSEHFSHSSKWLETCQHESDEQPLDPIPQISSTPKTSEEAVDPLGNYMVKTIVLVPSPLGQQQDMIFEARLDTMAETNSISLNGPLRTDDLVREEVAPCMGDRFSEVAAVSEKPIFQESPSHLLEESPPNPCSEQLHCSKESLSSRTEAVREDLVPSESNAFLPSSVLWLSPSTALAADFRVNHVDPEEEIVEHGAMEEREMRFPTHPKESETEDQALVSSVEDILSTCLTPNLVEMESQEAPGPAVEDVGRILGSDTESWMSPLAWLEKGVNTSVMLENLRQSLSLPSMLRDAAIGTTPFSTCSVGTWFTPSAPQEKSTNTSQTGLVGTKHSTSETEQLLCGRPPDLTALSRHDLEDNLLSSLVIVEFLSRQLRDWKSQLAVPHPETQDSSTQTDTSHSGITNKLQHLKESHEMGQALQQARNVMQSWVLISKELISLLHLSLLHLEEDKTTVNQESRRAETLVCCCFDLLKKLRAKLQSLKAEREEARHREEMALRGKDAAEIVLEAFCAHASQRISQLEQDLASMREFRGLLKDAQTQLVGLHAKQEELVQQTVSLTSTLQQDWRSMQLDYTTWTALLSRSRQLTEKLTVKSQQALQERDVAIEEKQEVSRVLEQVSAQLEECKGQTEQLELENIRLATDLRAQLQILANMDSQLKELQSQHTHCAQDLAMKDELLCQLTQSNEEQAAQCVKEEMALKHMQAELQQQQAVLAKEVRDLKETLEFADQENQVAHLELGQVECQLKTTLEVLRERSLQCENLKDTVENLTAKLASTIADNQEQDLEKTRQYSQKLGLLTEQLQSLTLFLQTKLKEKTEQETLLLSTACPPTQEHPLPNDRTFLGSILTAVADEEPESTPVPLLGSDKSAFTRVASMVSLQPAETPGMEESLAEMSIMTTELQSLCSLLQESKEEAIRTLQRKICELQARLQAQEEQHQEVQKAKEADIEKLNQALCLRYKNEKELQEVIQQNEKILEQIDKSGELISLREEVTHLTRSLRRAETETKVLQEAWQASWTPTASLWPPIGSRRKCGSLRRWTN

SEQ ID NO: 675 - protein, 540 aa, Homo sapiens
MGTTARAALVLTYLAVASAASEGGFTATGQRQLRPEHFQEVGYAAPPSPPLSRSLPMDHPDSSQHGPPFEGQSQVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEEAMSRFCEAEFSVKTRPHWCCTRQGEARFSCFQEEAPQPHYQLRACPSHQPDISSGLELPFPPGVPTLDNIKNICHLRRFRSVPRNLPATDPLQRELLALIQLEREFQRCCRQGNNHTCTWKAWEDTLDKYCDREYAVKTHHHLCCRHPPSPTRDECFARRAPYPNYDRDILTIDISRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 676 - protein, 462 aa, Homo sapiens [sequence omitted]

SEQ ID NO: 677 - protein, 2328 aa, Homo sapiens
KSKRQAQQMVQPQSPVAVSQSKPGCYDNGKHYQINQQWERTYLGNVLVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNLNGEPCVLPFTYNGRTFYSCTTEGRQDGHLWCSTTSNYEQDQKYSFCTDHTVLVQTQGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 678 - protein, 188 aa, Homo sapiens
HQTHKEGGSTHASADAWEIIELETEIEKFKAENASLAKLRIERESALEKLRKEIADFEQQKAKELARIEEFKKEEMRKLQKERKVFEKYTTAARTFPDKKEREEIQTLKQQIADLREDLKRKETKWSSTHSRLRSQIQMLVRENTDLREEIKVMERFRLDAWKRAEAIESSLEVEKKDKLANTSVRFQ

SEQ ID NO: 679 - protein, 284 aa, Homo sapiens
MEPGNYATLDGAKDIEGLLGAGGGRNLVAHSPLTSHPAAPTLMPAVNYAPLDLPGSAEPPKQCHPCPGVPQGTSPAPVPYGYFGGGYYSCRVSRSSLKPCAQAATLAAYPAETPTAGEEYPSRPTEFAFYPGYPGTYHAMASYLDVSVVQTLGAPGEPRHDSLLPVDSYQSWALAGGWNSQMCCQGEQNPPGPFWKAAFADSSGQHPPDACAFRRGRKKRIPYSKGQLRELEREYAANKFITKDKRRKISAATSLSERQITIWFQNRRVKEKKVLAKVKNSATP

SEQ ID NO: 680 - protein, 676 aa, Homo sapiens
MDKYDDLGLEASKFIEDLNMYEASKDGLFRVDKGAGNNPEFEETRRVFATKMAKIHLQQQQQQLLQEETLPRGSRGPVNGGGRLGPQARWEVVGSKLTVDGAAKPPLAASTGAPGAVTTLAAGQPPYPPQEQRSRPYLHGTRHGSQDCGSRESLATSEMSAFHQPGPCEDPSCLTHGDYYDNLSLASPKWGDKPGVSPSIGLSVGSGWPSSPGSDPPLPKPCGDHPLNHRQLSLSSSRSSEGSLGGQNSGIGGRSSEKPTGLWSTASSQRVSPGLPSPNLENGAPAVGPVQPRTPSVSAPLALSCPRQGGLPRSNSGLGGEVSGVMSKPNVDPQPWFQDGPKSYLSSSAPSSSPAGLDGSQQGAVPGLGPKPGCTDLGTGPKLSPTSLVHPVMSTLPELSCKEGPLGWSSDGSLGSVLLDSPSSPRVRLPCQPLVPGPELRPSAAELKLEALTQRLEREMDAHPKADYFGACVKCSKGVFGAGQACQAMGNLYHDTCFTCAACSRKLRGKAFYFVNGKVFCEEDFLYSGFQQSADRCFLCGHLIMDMILQALGKSYHPGCFRCVICNECLDGVPFTVDSENKIYCVRDYHKVLAPKCAACGLPILPPEGSDETIRVVSMDRDYHVECYHCEDCGLELNDEDGHRCYPLEDHLFCHSCHVKRLEKRPSSTALHQHHF

SEQ ID NO: 681 - protein, 296 aa, Homo sapiens
STGSEFPLCTKASPCSAARAGGRALGWRLQQQRETRGNPGNPGLGVAATMTGSNMSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCEL

SEQ ID NO: 682 - protein, 500 aa, Homo sapiens
MGIGLSAQGVNMNRLPGWDKHSYGYHGDDGHSFCSSGTGQPYGPTFTTGDVIGCCVNLINNTCFYTKNGHSLGIAFTDLPPNLYPTVGLQTPGEVVDANFGQHPFVFDIEDYMREWRTKIQAQIDRFPIGDREGEWQTMIQKMVSSYLVHHGYCATAEAFARSTDQTVLEELASIKNRQRIQKLVLAGRMGEAIETTQQLYPSLLERNPNLLFTLKVRQFIEMVNGTDSEVRCLGGRSPKSQDSYPVSPRPFSSPSMSPSHGMNIHNLASGKGSTAHFSGFESCSNGVISNKAHQSYCHSNKHQSSNLNVPELNSINMSRSQQVNNFTSNDVDMETDHYSNGVGETSSNGFLNGSSKHDHEMEDCDTEMEVDSSQLRRQLCGGSQAAIERMIHFGRELQAMSEQLRRDCGKNTANKKMLKDAFSLLAYSDPWNSPVGNQLDPIQREPVCSALNSAILETHNLPKQPPLALAMGQATQCLGLMARSGIGSCAFATVEDYLH

SEQ ID NO: 683 - protein, 387 aa, Homo sapiens
MATSGVLPGGGFVASAAAVAGPEMQTGRNNFVIRRNPADPQRIPSNPSHRIQCAAGYEQSEHNVCQDIDECTAGTHNCRADQVCINLRGSFACQCPPGYQKRGEQCVDIDECTIPPYCHQRCVNTPGSFYCQCSPGFQLAANNYTCVDINECDASNQCAQQCYNILGSFICQCNQGYELSSDRLNCEDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 684 - protein, 531 aa, Homo sapiens [sequence omitted]

SEQ ID NO: 685 - protein, 480 aa, Homo sapiens
MAARCSTRWLLVVVGTPRLPAISGRGARPPREGVVGAWLSRKLSVPAFASSLTSCGPRALLTLRPGVSLTGTKHNPFICTASFHTSAPLAKEDYYQILGVPRNASQKEIKKAYYQLAKKYHPDTNKDDPKAKEKFSQLAEAYEVLSDEVKRKQYDAYGSAGFDPGASGSQHSYWKGGPTVDPEELFRKIFGEFSSSSFGDFQTVFDQPQEYFMELTFNQAAKGVNKEFTVNIMDTCERCNGKGNEPGTKVQHCHYCGGSGMETINTGPFVMRSTCRRCGGRGSIIISPCVVCRGAGQAKQKKRVMIPVPAGVEDGQTVRMPVGKREIFITFRVQKSPVFRRDGADIHSDLFISIAQALLGGTARAQGLYETINVTIPPGTQTDQKIRMGGKGIPRINSYGYGDHYIHIKIRVPKRLTSRQQSLILSYAEDETDVEGTVNGVTLTSSGGSTMDSSAGSKARREAGEDEEGFLSKLKKMFTS

SEQ ID NO: 686 - protein, 572 aa, Homo sapiens
MAAPRPSPAISVSVSAPAFYAPQKKFGPVVAPKPKVNPFRPGDSEPPPAPGAQRAQMGRVGEIPPPPPEDFPLPPPPLAGDGDDAEGALGGAFPPPPPPIEESFPPAPLEEEIFPSPPPPPEEEGGPEAPIPPPPQPREKVSSIDLEIDSLSSLLDDMTKNDPFKARVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 687 - protein, 2861 aa, Homo sapiens
MKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRHVRTIWQHRKVRLHQRLQLCVFQQEVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLHVRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGKIVAQGKLLLQDTFLVTDQDAGLLPRCRERRIFLFEQIVIFSEPLDKKKGFSMPGFLFKNSIKVSCLCLEENVENDPCKFALTSRTGDVVETFILHSSSPSVRQTWIHEINQILENQRNFLNALTSPIEYQRNHSGGGGGGGSGAAAGVGAAAAAGPPVAAAATVAAPAAAAAPPARAGAGPPGSPSLSDTTPPCWSPLQPRARQRQTRCQSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRGRFSVVKKCDQKGTKRAVATKFVNKKLMKRDQVTHELGILQSLQHPLLVGLLDTFETPTSYILVLEMADQGRLLDCVVRWGSLTEGKIRAHLGEVLEAVRYLHNCRIAHLDLKPENILVDESLAKPTIKLADFGDAVQLNTTYYIHQLLGNPEFAAPEIILGNPVSLTSDTWSVGVLTYVLLSGVSPFLDDSVEETCLNICRLDFSFPDDYFKGVSQKAKEFVCFLLQEDPAKRPSAALALQEQWLQAGNGRSTGVLDTSRLTSFIERRKHQNDVRPIRSIKNFLQSRLLPRV

SEQ ID NO: 688 - protein, 271 aa, Homo sapiens
MVLIKEFRVVLPCSVQEYQVGQLYSVAEASKNETGGGEGIEVLKNEPYEKDGEKGQYTHKIYHLKSKVPAFVRMIAPEGSLVFHEKAWNAYPYCRTIVTNEYMKDDFFIKIETWHKPDLGTLENVHGLDPNTWKTVEIVHIDIADRSQVEPADYKADEDPALFQSVKTKRGPLGPNWKKELANSPDCPQMCAYKLVTIKFKWWGLQSKVENFIQKQEKRIFTNFHRQLFCWIDKWIDLTMEDIRRMEDETQKELETMRKRGSVRGTSAADV

SEQ ID NO: 689 - DNA, 21 bp, Homo sapiens
gtcagcctggaggagttctca

SEQ ID NO: 690 - DNA, 22 bp, Homo sapiens
tcacccttggcaatacagatgt

SEQ ID NO: 691 - DNA, 21 bp, Homo sapiens
cccacccatgtgcccgtgaca

SEQ ID NO: 692 - DNA, 19 bp, Homo sapiens
cgtgattgccgacgatctc

SEQ ID NO: 693 - DNA, 19 bp, Homo sapiens
ttccggccgctagtcttgt

SEQ ID NO: 694 - DNA, 26 bp, Homo sapiens
cgcacccgttcggtctgacgcagtac

SEQ ID NO: 695 - DNA, 22 bp, Homo sapiens
ctttccccacgagtatgttggt

SEQ ID NO: 696 - DNA, 19 bp, Homo sapiens
aagggaccgtgctgtgagc

SEQ ID NO: 697 - DNA, 29 bp, Homo sapiens
agcccctcatgtgcctctcaacttcatag

SEQ ID NO: 698 - protein, 6 aa, Artificial Sequence
  Description of Artificial Sequence: Synthetic peptide
SPAHSS

SEQ ID NO: 699 - DNA, 25 bp, Artificial Sequence
  Description of Artificial Sequence: Synthetic oligonucleotide
tcgaccaccatggaggcagcgccgc

SEQ ID NO: 700 - DNA, 25 bp, Artificial Sequence
  Description of Artificial Sequence: Synthetic oligonucleotide
ggtggtacctccgtcgcggcgggcc

SEQ ID NO: 701 - DNA, 55 bp, Artificial Sequence
  Description of Artificial Sequence: Synthetic oligonucleotide
catgtgtgaaatcaccaagccgccctcagacgacagcccggcccacagcagtggc

SEQ ID NO: 702 - DNA, 63 bp, Artificial Sequence
  Description of Artificial Sequence: Synthetic oligonucleotide
ggccgccactgctgtgggccgggctgtcgtctgagggcggcttggtgatttcacacatgagct

SEQ ID NO: 703 - protein, 17 aa, Homo sapiens
VETPRIERAGMDGSTRK

SEQ ID NO: 704 - protein, 15 aa, Homo sapiens
NKRTGGKRKEILSAL

SEQ ID NO: 705 - protein, 12 aa, Homo sapiens
ERQPFFHTRCEE

SEQ ID NO: 706 - protein, 15 aa, Homo sapiens
VDGTKRRTLLEDKLP

SEQ ID NO: 707 - protein, 15 aa, Homo sapiens
DGLNDCMHNNGQCGQ

SEQ ID NO: 708 - protein, 12 aa, Homo sapiens
PFVLTSLSQGQN

SEQ ID NO: 709 - protein, 15 aa, Homo sapiens
YAGANGPFPHEYVSG

SEQ ID NO: 710 - protein, 13 aa, Homo sapiens
ACGKSMMSSVSLM

SEQ ID NO: 711 - protein, 18 aa, Homo sapiens
RWKASKYYLDLNSDSDPY

SEQ ID NO: 712 - protein, 15 aa, Homo sapiens
SGWNECASSNGHCSH

SEQ ID NO: 713 - protein, 14 aa, Homo sapiens
NGDANCQDKSDEKN

SEQ ID NO: 714 - protein, 22 aa, Artificial Sequence
  Description of Artificial Sequence: Synthetic peptide
IKRAKDDGTQPFVLTSLSQGQN

SEQ ID NO: 715 - DNA, 38 bp, Artificial Sequence
  Description of Artificial Sequence: Synthetic oligonucleotide
cgtacgtaaagcggccgcttggcaatacagatgtggga

SEQ ID NO: 716 - DNA, 37 bp, Artificial Sequence
  Description of Artificial Sequence: Synthetic oligonucleotide
cgtacgtaaagcggccgcagtagctcctctcggtggc

SEQ ID NO: 717 - DNA, 37 bp, Artificial Sequence
  Description of Artificial Sequence: Synthetic oligonucleotide
cgtacgtaaagcggccgcgctcatcatggactttccg

SEQ ID NO: 718 - DNA, 37 bp, Artificial Sequence
  Description of Artificial Sequence: Synthetic oligonucleotide
cgtacgtaaagcggccgcgcactgctgtttgatgagg

SEQ ID NO: 719 - DNA, 38 bp, Artificial Sequence
  Description of Artificial Sequence: Synthetic oligonucleotide
cgtacgtaaagcggccgcgagtgtggaagaaaggctgc

SEQ ID NO: 720 - DNA, 38 bp, Artificial Sequence
  Description of Artificial Sequence: Synthetic oligonucleotide
cgtacgtaaagcggccgcagtagagcttcccctcctgc

SEQ ID NO: 721 - DNA, 38 bp, Artificial Sequence
  Description of Artificial Sequence: Synthetic oligonucleotide
cgtacgtaaagcggccgcgtccatcacgaagtccaggt

SEQ ID NO: 722 - DNA, 18 bp, Artificial Sequence
  Description of Artificial Sequence: Synthetic oligonucleotide
cagcggcctggaggatgc

SEQ ID NO: 723 - DNA, 19 bp, Artificial Sequence
  Description of Artificial Sequence: Synthetic oligonucleotide
cggtccagtagaggtttcg

SEQ ID NO: 724 - DNA, 19 bp, Artificial Sequence
  Description of Artificial Sequence: Synthetic oligonucleotide
catcagccgcgccttcatg

SEQ ID NO: 725 - DNA, 20 bp, Artificial Sequence
  Description of Artificial Sequence: Synthetic oligonucleotide
cctgcatgttggtgaagtac

SEQ ID NO: 726 - DNA, 24 bp, Artificial Sequence
  Description of Artificial Sequence: Synthetic primer
gcccgaaacctctactggaccgac

SEQ ID NO: 727 - DNA, 24 bp, Artificial Sequence
  Description of Artificial Sequence: Synthetic primer
gcccaccccatcacagttcacatt

SEQ ID NO: 728 - DNA, 18 bp, Artificial Sequence
  Description of Artificial Sequence: Synthetic oligonucleotide
cagcggcctggaggatgc

SEQ ID NO: 729 - DNA, 29 bp, Artificial Sequence
  Description of Artificial Sequence: Synthetic oligonucleotide
cgggtacatgtactggacagctgattagc

SEQ ID NO: 730 - DNA, 21 bp, Artificial Sequence
  Description of Artificial Sequence: Synthetic primer
gtcagcctggaggagttctca

SEQ ID NO: 731 - DNA, 22 bp, Artificial Sequence
  Description of Artificial Sequence: Synthetic primer
tcacccttggcaatacagatgt

SEQ ID NO: 732 - DNA, 21 bp, Artificial Sequence
  Description of Artificial Sequence: Synthetic probe
cccacccatgtgcccgtgaca

SEQ ID NO: 733 - DNA, 19 bp, Artificial Sequence
  Description of Artificial Sequence: Synthetic primer
cgtgattgccgacgatctc

SEQ ID NO: 734 - DNA, 19 bp, Artificial Sequence
  Description of Artificial Sequence: Synthetic primer
ttccggccgctagtcttgt

SEQ ID NO: 735 - DNA, 26 bp, Artificial Sequence
  Description of Artificial Sequence: Synthetic probe
cgcacccgttcggtctgacgcagtac

SEQ ID NO: 736 - DNA, 22 bp, Artificial Sequence
  Description of Artificial Sequence: Synthetic primer
ctttccccacgagtatgttggt

SEQ ID NO: 737 - DNA, 19 bp, Artificial Sequence
  Description of Artificial Sequence: Synthetic primer
aagggaccgtgctgtgagc

SEQ ID NO: 738 - DNA, 29 bp, Artificial Sequence
  Description of Artificial Sequence: Synthetic probe
agcccctcatgtgcctctcaacttcatag

SEQ ID NO: 739 - DNA, 20 bp, Artificial Sequence
  Description of Artificial Sequence: Synthetic primer
gagcgggcagggatggatgg

SEQ ID NO: 740 - DNA, 22 bp, Artificial Sequence
  Description of Artificial Sequence: Synthetic primer
aggttggcacggtggatgaagc

SEQ ID NO: 741 - DNA, 40 bp, Artificial Sequence
  Description of Artificial Sequence: Synthetic primer
aagcttgtttaaactgggcatggtggcacatggttgtaat

SEQ ID NO: 742 - DNA, 34 bp, Artificial Sequence
  Description of Artificial Sequence: Synthetic primer
gggcttccacccagtcagtccagtacatgtacct

SEQ ID NO: 743 - DNA, 30 bp, Artificial Sequence
  Description of Artificial Sequence: Synthetic primer
ctgactgggtggaagcaccccggatcgagc

SEQ ID NO: 744 - DNA, 33 bp, Artificial Sequence
  Description of Artificial Sequence: Synthetic primer
gaattcatcggtacctgtgcggccgcttcattg

SEQ ID NO: 745 - DNA, 20 bp, Artificial Sequence
  Description of Artificial Sequence: Synthetic primer
tgagatgtcctgtctgtggc

SEQ ID NO: 746 - DNA, 20 bp, Artificial Sequence
  Description of Artificial Sequence: Synthetic primer
tccttccttccctacagttg

SEQ ID NO: 747 - DNA, 25 bp, Artificial Sequence
  Description of Artificial Sequence: Synthetic primer
cctaaggatctccttgtgtctgtgg

SEQ ID NO: 748 - DNA, 22 bp, Artificial Sequence
  Description of Artificial Sequence: Synthetic primer
ctgcagcaggtcagtagcctgc

SEQ ID NO: 749 - DNA, 20 bp, Artificial Sequence
  Description of Artificial Sequence: Synthetic primer
tgagatgtcctgtctgtggc

SEQ ID NO: 750 - DNA, 20 bp, Artificial Sequence
  Description of Artificial Sequence: Synthetic primer
tccttccttccctacagttg

SEQ ID NO: 751 - DNA, 21 bp, Artificial Sequence
  Description of Artificial Sequence: Synthetic primer
gcttctggcgtgtgaccggcg

SEQ ID NO: 752 - DNA, 22 bp, Artificial Sequence
  Description of Artificial Sequence: Synthetic primer
gccgcacagcgccagcagcagc

SEQ ID NO: 753 - DNA, 22 bp, Artificial Sequence
  Description of Artificial Sequence: Synthetic primer
cacccacgccccacagccagta

SEQ ID NO: 754 - DNA, 24 bp, Artificial Sequence
  Description of Artificial Sequence: Synthetic primer
atttgccctcccatatgtccttcc

SEQ ID NO: 755 - DNA, 24 bp, Artificial Sequence
  Description of Artificial Sequence: Synthetic primer
ttcctcccagccctcctccatcag

SEQ ID NO: 756 - DNA, 22 bp, Artificial Sequence
  Description of Artificial Sequence: Synthetic primer
gccgcacagcgccagcagcagc

SEQ ID NO: 757 - DNA, 19 bp, Artificial Sequence
  Description of Artificial Sequence: Synthetic primer
gaatggcgcccccgacgac

SEQ ID NO: 758 - DNA, 24 bp, Artificial Sequence
  Description of Artificial Sequence: Synthetic primer
gctcccattcatcagttccatagg

SEQ ID NO: 759 - DNA, 5278 bp, Homo sapiens
tctagactcgaggcggccgcccattgtgcactaaagcgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactgggttgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtagacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcggccgc

SEQ ID NO: 760 - DNA, 5278 bp, Homo sapiens
tctagactcgaggcggccgcccattgtgcactaaagcgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtagacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcggccgc

SEQ ID NO: 761 - protein, 1615 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEADCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 762 - protein, 1614 aa, Mus sp.
METAPTRAPPPPPPPLLLLVLYCSLVPAAASPLLLFANRRDVRLVDAGGVKLESTIVASGLEDAAAVDFQFSKGAVYWTDVSEEAIKQTYLNQTGAAAQNIVISGLVSPDGLACDWVGKKLYWTDSETNRIEVANLNGTSRKVLFWQDLDQPRAIALDPAHGYMYWTDWGEAPRIERAGMDGSTRKIIVDSDIYWPNGLTIDLEEQKLYWADAKLSFIHRANLDGSFRQKVVEGSLTHPFALTLSGDTLYWTDWQTRSIHACNKWTGEQRKEILSALYSPMDIQVLSQERQPPFHTPCEEDNGGCSHLCLLSPREPFYSCACPTGVQLQDNGKTCKTGAEEVLLLARRTDLRRISLDTPDFTDIVLQVGDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIVLHPVMGLMYWTDWGENPKIECANLDGRDRHVLVNTSLGWPNGLALDLQEGKLYWGDAKTDKIEVINIDGTKRKTLLEDKLPHIFGFTLLGDFIYWTDWQRRSIERVHKVKASRDVIIDQLPDLMGLKAVNVAKVVGTNPCADGNGGCSHLCFFTPRATKCGCPIGLELLSDMKTCIIPEAFLVFTSRATIHRISLETNNNDVAIPLTGVKEASALDFDVSNNHIYWTDVSLKTISRAFMNGSSVEHVIEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERMVIADDLPYPFGLTQYSDYIYWTDWNLHSIERADKTSGRNRTLIQGHLDFVMDILVFHSSRQDGLNDCVHSNGQCGQLCLAIPGGHRCGCASHYTLDPSSRNCSPPSTFLLFSQKFAISRMIPDDQLSPDLVLPLHGLRNVKAINYDPLDKFIYWVDGRQNIKRAKDDGTQPSMLTSPSQSLSPDRQPHDLSIDIYSRTLFWTCEATNTINVHRLDGDAMGVVLRGDRDKPRAIAVNAERGYMYFTNMQDHAAKIERASLDGTEREVLFTTGLIRPVALVVDNALGKLFWVDADLKRIESCDLSGANRLTLEDANIVQPVGLTVLGRHLYWIDRQQQMIERVEKTTGDKRTRVQGRVTHLTGIHAVEEVSLEEFSAHPCARDNGGCSHICIAKGDGTPRCSCPVHLVLLQNLLTCGEPPTCSPDQFACTTGEIDCIPGAWRCDGFPECADQSDEEGCPVCSASQFPCARGQCVDLRLRCDGEADCQDRSDEANCDAVCLPNQFRCTSGQCVLIKQQCDSFPDCADGSDELMCEINKPPSDDIPAHSSAIGPVIGIILSLFVMGGVYFVCQRVMCQRYTGASGPFPHEYVGGAPHVPLNFIAPGGSQHGPFPGIPCSKSVMSSMSLVGGRGSVPLYDRNHVTGASSSSSSSTKATLYPPILNPPPSPATDPSLYNVDVFYSSGIPATARPYRPYVIRGMAPPTTPCSTDVCDSDYSISRWKSSKYYLDLNSDSDPYPPPPTPHSQYLSAEDSCPPSPGTERSYCHLFPPPPSPCTDSS

SEQ ID NO: 763 - protein, 1615 aa, Homo sapiens; identical to SEQ ID NO: 761

SEQ ID NO: 764 - protein, 1613 aa, Homo sapiens
MGAVLRSLLACSFCVLLRAAPLLLYANRRDLRLVDATNGKENATIVVGGLEDAAAVDFVFSHGLIYWSDVSEEAIKRTEFNKTESVQNVVVSGLLSPDGLACDWLGEKLYWTDSETNRIEVSNLDGSLRKVLFWQELDQPRAIALDPSSGFMYWTDWGEVPKIERAGMDGSSRFIIINSEIYWPNGLTLDYEEQKLYWADAKLNFIHKSNLDGTNRQAVVKGSLPHPFALTLFEDILYWTDWSTHSILACNKYTGEGLREIHSDIFSPMDIHAFSQQRQPNATNPCGIDNGGCSHLCLMSPVKPFYQCACPTGVKLLENGKTCKDGATELLLLARRTDLRRISLDTPDFTDIVLQLEDIRHAIAIDYDPVEGYIYWTDDEVRAIRRSFIDGSGSQFVVTAQIAHPDGIAVDWVARNLYWTDTGTDRIEVTRLNGTMRKILISEDLEEPRAIVLDPMVGYMYWTDWGEIPKIERAALDGSDRVVLVNTSLGWPNGLALDYDEGKIYWGDAKTDKIEVMNTDGTGRRVLVEDKIPHIFGFTLLGDYVYWTDWQRRSIERVHKRSAEREVIIDQLPDLMGLKATNVHRVIGSNPCAEENGGCSHLCLYRPQGLRCACPIGFELISDMKTCIVPEAFLLFSRRADIRRISLETNNNNVAIPLTGVKEASALDFDVTDNRIYWTDISLKTISRAFMNGSALEHVVEFGLDYPEGMAVDWLGKNLYWADTGTNRIEVSKLDGQHRQVLVWKDLDSPRALALDPAEGFMYWTEWGGKPKIDRAAMDGSERTTLVPNVGRANGLTIDYAKRRLYWTDLDTNLIESSNMLGLNREVIADDLPHPFGLTQYQDYIYWTDWSRRSIERANKTSGQNRTIIQGHLDYVMDILVFHSSRQSGWNECASSNGHCSHLCLAVPVGGFVCGCPAHYSLNADNRTCSAPTTFLLFSQKSAINRMVIDEQQSPDIILPIHSLRNVRAIDYDPLDKQLYWIDSRQNMIRKAQEDGSQGFTVVVSSVPSQNLEIQPYDLSIDIYSRYIYWTCEATNVINVTRLDGRSVGVVLKGEQDRPRAIVVNPEKGYMYFTNLQERSPKIERAALDGTEREVLFFSGLSKPIALALDSRLGKLFWADSDLRRIESSDLSGANRIVLEDSNILQPVGLTVFENWLYWIDKQQQMIEKIDMTGREGRTKVQARIAQLSDIHAVKELNLQEYRQHPCAQDNGGCSHICLVKGDGTTRCSCPMHLVLLQDELSCGEPPTCSPQQFTCFTGEIDCIPVAWRCDGFTECEDHSDELNCPVCSESQFQCASGQCIDGALRCNGDANCQDKSDEKNCEVLCLIDQFRCANGQCIGKHKKCDHNVDCSDKSDELDCYPTEEPAPQATNTVGSVIGVIVTIFVSGTVYFICQRMLCPRMKGDGETMTNDYVVHGPASVPLGYVPHPSSLSGSLPGMSRGKSMISSLSIMGGSSGPPYDRAHVTGASSSSSSSTKGTYFPAILNPPPSPATERSHYTMEFGYSSNSPSTHRSYSYRPYSYRHFAPPTTPCSTDVCDSDYAPSRRMTSVATAKGYTSDLNYDSEPVPPPPTPRSQYLSAEENYESCPPSPYTERSYSHHLYPPPPSPCTDSS

SEQ ID NO: 765 - protein, 207 aa, Artificial Sequence
  Description of Artificial Sequence: Synthetic polypeptide
RVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATVRPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 766 - protein, 16 aa, Homo sapiens
KLYWADAKLSFIHRAN

SEQ ID NO: 767 - protein, 15 aa, Homo sapiens
ALYSPMDIQVLSQER

SEQ ID NO: 768 - protein, 16 aa, Homo sapiens
GLEDAAAVDFQFSKGA

SEQ ID NO: 769 - protein, 14 aa, Homo sapiens
EGSLTHPFALTLSG

SEQ ID NO: 770 - protein, 16 aa, Homo sapiens
TLYWTDWQTRSIHACN

SEQ ID NO: 771 - protein, 13 aa, Homo sapiens
VLFWQDLDQPRAI

SEQ ID NO: 772 - protein, 17 aa, Homo sapiens
IYWPNGLTIDLEEQKLY

SEQ ID NO: 773 - protein, 14 aa, Homo sapiens
LLLFANRRDVRLVD

SEQ ID NO: 774 - protein, 15 aa, Homo sapiens
GAVYWTDVSEEAIKQ

SEQ ID NO: 775 - protein, 15 aa, Homo sapiens
KLYWTDSETNRIEVA

SEQ ID NO: 776 - DNA, 39 bp, Artificial Sequence
  Description of Artificial Sequence: Synthetic oligonucleotide
tggtcagcggcctggaggatgtggccgcagtggacttcc

SEQ ID NO: 777 - DNA, 39 bp, Artificial Sequence
  Description of Artificial Sequence: Synthetic oligonucleotide
ggaagtccactgcggccacatcctccaggccgctgacca

SEQ ID NO: 778 - DNA, 40 bp, Artificial Sequence
  Description of Artificial Sequence: Synthetic oligonucleotide
aagctgtactggacggactcagtgaccaaccgcatcgagg

SEQ ID NO: 779 - DNA, 40 bp, Artificial Sequence
  Description of Artificial Sequence: Synthetic oligonucleotide
cctcgatgcggttggtcactgagtccgtccagtacagctt

SEQ ID NO: 780 - DNA, 41 bp, Artificial Sequence
  Description of Artificial Sequence: Synthetic oligonucleotide
atgtactggacagactggaaggagacgccccggattgagcg

SEQ ID NO: 781 - DNA, 41 bp, Artificial Sequence
  Description of Artificial Sequence: Synthetic oligonucleotide
cgctcaatccggggcgtctccttccagtctgtccagtacat

SEQ ID NO: 782 - DNA, 41 bp, Artificial Sequence
  Description of Artificial Sequence: Synthetic oligonucleotide
atgtactggacagactggtttgagacgccccggattgagcg

SEQ ID NO: 783 - DNA, 41 bp, Artificial Sequence
  Description of Artificial Sequence: Synthetic oligonucleotide
cgctcaatccggggcgtctcaaaccagtctgtccagtacat

SEQ ID NO: 784 - DNA, 41 bp, Artificial Sequence
  Description of Artificial Sequence: Synthetic oligonucleotide
atgtactggacagactggattgagacgccccggattgagcg

SEQ ID NO: 785 - DNA, 41 bp, Artificial Sequence
  Description of Artificial Sequence: Synthetic oligonucleotide
cgctcaatccggggcgtctcaatccagtctgtccagtacat

SEQ ID NO: 786 - DNA, 41 bp, Artificial Sequence
  Description of Artificial Sequence: Synthetic oligonucleotide
atgtactggacagactggcaggagacgccccggattgagcg

SEQ ID NO: 787 - DNA, 41 bp, Artificial Sequence
  Description of Artificial Sequence: Synthetic oligonucleotide
cgctcaatccggggcgtctcctgccagtctgtccagtacat

SEQ ID NO: 788 - DNA, 42 bp, Artificial Sequence
  Description of Artificial Sequence: Synthetic oligonucleotide
cggacatttactggcccaatgtactgaccatcgacctggagg

SEQ ID NO: 789 - DNA, 42 bp, Artificial Sequence
  Description of Artificial Sequence: Synthetic oligonucleotide
cctccaggtcgatggtcagtacattgggccagtaaatgtccg

SEQ ID NO: 790 - DNA, 40 bp, Artificial Sequence
  Description of Artificial Sequence: Synthetic oligonucleotide
agctctactgggctgacgtcaagctcagcttcatccaccg

SEQ ID NO: 791 - DNA, 40 bp, Artificial Sequence
  Description of Artificial Sequence: Synthetic oligonucleotide
cggtggatgaagctgagcttgacgtcagcccagtagagct

SEQ ID NO: 792 - DNA, 41 bp, Artificial Sequence
  Description of Artificial Sequence: Synthetic oligonucleotide
gagtgccctctactcacccgtggacatccaggtgctgagcc

SEQ ID NO: 793 - DNA, 41 bp, Artificial Sequence
  Description of Artificial Sequence: Synthetic oligonucleotide
ggctcagcacctggatgtccacgggtgagtagagggcactc

SEQ ID NO: 794 - DNA, 45 bp, Artificial Sequence
  Description of Artificial Sequence: Synthetic oligonucleotide
catgtactggacagactgggtagagaaccctaaaatcgagtgtgc

SEQ ID NO: 795 - DNA, 45 bp, Artificial Sequence
  Description of Artificial Sequence: Synthetic oligonucleotide
gcacactcgattttagggttctctacccagtctgtccagtacatg

SEQ ID NO: 796 - DNA, 42 bp, Artificial Sequence
  Description of Artificial Sequence: Synthetic oligonucleotide
catctactggaccgagtgggtcggcaagccgaggatcgtgcg

SEQ ID NO: 797 - DNA, 42 bp, Artificial Sequence
  Description of Artificial Sequence: Synthetic oligonucleotide
cgcacgatcctcggcttgccgacccactcggtccagtagatg

SEQ ID NO: 798 - DNA, 42 bp, Artificial Sequence
  Description of Artificial Sequence: Synthetic oligonucleotide
gtacttcaccaacatggtggaccgggcagccaagatcgaacg

SEQ ID NO: 799 - DNA, 42 bp, Artificial Sequence
  Description of Artificial Sequence: Synthetic oligonucleotide
cgttcgatcttggctgcccggtccaccatgttggtgaagtac

SEQ ID NO: 800 - DNA, 42 bp, Artificial Sequence
  Description of Artificial Sequence: Synthetic oligonucleotide
gtactggacagactgggtagaagtgccaaagatagaacgtgc

SEQ ID NO: 801 - DNA, 42 bp, Artificial Sequence
  Description of Artificial Sequence: Synthetic oligonucleotide
gcacgttctatctttggcacttctacccagtctgtccagtac

SEQ ID NO: 802 - DNA, 13 bp, Artificial Sequence
  Description of Artificial Sequence: Synthetic oligonucleotide
cgaggaggccatc

SEQ ID NO: 803 - DNA, 10 bp, Artificial Sequence
  Description of Artificial Sequence: Synthetic oligonucleotide
agacctacct

SEQ ID NO: 804 - DNA, 10 bp, Artificial Sequence
  Description of Artificial Sequence: Synthetic oligonucleotide
gtgagacgcc

SEQ ID NO: 805 - DNA, 14 bp, Artificial Sequence
  Description of Artificial Sequence: Synthetic oligonucleotide
cgtacctggacggg

SEQ ID NO: 806 - DNA, 14 bp, Artificial Sequence
  Description of Artificial Sequence: Synthetic oligonucleotide
cgggttcacgctgc

SEQ ID NO: 807 - DNA, 14 bp, Artificial Sequence
  Description of Artificial Sequence: Synthetic oligonucleotide
ggccttcttggtct

SEQ ID NO: 808 - DNA, 14 bp, Artificial Sequence
  Description of Artificial Sequence: Synthetic oligonucleotide
gtggccatcccgct

SEQ ID NO: 809 - DNA, 13 bp, Artificial Sequence
  Description of Artificial Sequence: Synthetic oligonucleotide
cagaatcgaagtg

SEQ ID NO: 810 - DNA, 10 bp, Artificial Sequence
  Description of Artificial Sequence: Synthetic oligonucleotide
ggacactgtt

SEQ ID NO: 811 - DNA, 12 bp, Artificial Sequence
  Description of Artificial Sequence: Synthetic oligonucleotide
cggcaccgagcg

SEQ ID NO: 812 - DNA, 13 bp, Artificial Sequence
  Description of Artificial Sequence: Synthetic oligonucleotide
agacaacacactg

SEQ ID NO: 813 - DNA, 10 bp, Artificial Sequence
  Description of Artificial Sequence: Synthetic oligonucleotide
gactcgcatc

SEQ ID NO: 814 - DNA, 10 bp, Artificial Sequence
  Description of Artificial Sequence: Synthetic oligonucleotide
cggactgtga

SEQ ID NO: 815 - DNA, 13 bp, Artificial Sequence
  Description of Artificial Sequence: Synthetic oligonucleotide
cagcccggcccac

SEQ ID NO: 816 - DNA, 12 bp, Artificial Sequence
  Description of Artificial Sequence: Synthetic oligonucleotide
gggggccaacgg

SEQ ID NO: 817 - DNA, 10 bp, Artificial Sequence
  Description of Artificial Sequence: Synthetic oligonucleotide
cggccactgc

SEQ ID NO: 818 - DNA, 14 bp, Artificial Sequence
  Description of Artificial Sequence: Synthetic oligonucleotide
cgacgtgtgtgaca

SEQ ID NO: 819 - DNA, 14 bp, Artificial Sequence
  Description of Artificial Sequence: Synthetic oligonucleotide
ctctctctcgaatt

SEQ ID NO: 820 - DNA, 14 bp, Artificial Sequence
  Description of Artificial Sequence: Synthetic oligonucleotide
tcagtccacactcg

SEQ ID NO: 821 - DNA, 14 bp, Artificial Sequence
  Description of Artificial Sequence: Synthetic oligonucleotide
gggcgggggctggg

SEQ ID NO: 822 - DNA, 13 bp, Artificial Sequence
  Description of Artificial Sequence: Synthetic oligonucleotide
gcagagaccagac

SEQ ID NO: 823 - DNA, 14 bp, Artificial Sequence
  Description of Artificial Sequence: Synthetic oligonucleotide
tgctcttgggcatt

SEQ ID NO: 824 - DNA, 14 bp, Artificial Sequence
  Description of Artificial Sequence: Synthetic oligonucleotide
tgggggtgagtcct

SEQ ID NO: 825 - DNA, 14 bp, Artificial Sequence
  Description of Artificial Sequence: Synthetic oligonucleotide
tgtttgcctgtccc

SEQ ID NO: 826 - DNA, 13 bp, Artificial Sequence
  Description of Artificial Sequence: Synthetic oligonucleotide
atgtgtgtggcag

SEQ ID NO: 827 - DNA, 13 bp, Artificial Sequence
  Description of Artificial Sequence: Synthetic oligonucleotide
ggtctcgcccttc

SEQ ID NO: 828 - DNA, 14 bp, Artificial Sequence
  Description of Artificial Sequence: Synthetic oligonucleotide
cggtgagagcagac

SEQ ID NO: 829 - DNA, 13 bp, Artificial Sequence
  Description of Artificial Sequence: Synthetic oligonucleotide
cggggcagccggg

SEQ ID NO: 830 - DNA, 14 bp, Artificial Sequence
  Description of Artificial Sequence: Synthetic oligonucleotide
gtaccctgtggcct

SEQ ID NO: 831 - DNA, 14 bp, Artificial Sequence
  Description of Artificial Sequence: Synthetic oligonucleotide
ctcatctggggttc

SEQ ID NO: 832 - DNA, 14 bp, Artificial Sequence
  Description of Artificial Sequence: Synthetic oligonucleotide
atgatgctacctgg

SEQ ID NO: 833 - DNA, 14 bp, Artificial Sequence
  Description of Artificial Sequence: Synthetic oligonucleotide
cgggaatttggaga

SEQ ID NO: 834 - DNA, 14 bp, Artificial Sequence
  Description of Artificial Sequence: Synthetic oligonucleotide
ttgttcaactagta

SEQ ID NO: 835 - DNA, 13 bp, Artificial Sequence
  Description of Artificial Sequence: Synthetic oligonucleotide
tccgaggagacgc

SEQ ID NO: 836 - DNA, 14 bp, Artificial Sequence
  Description of Artificial Sequence: Synthetic oligonucleotide
ttgtttccggcatc

SEQ ID NO: 837 - DNA, 13 bp, Artificial Sequence
  Description of Artificial Sequence: Synthetic oligonucleotide
catttggccccta

SEQ ID NO: 838 - DNA, 10 bp, Artificial Sequence
  Description of Artificial Sequence: Synthetic oligonucleotide
gcccagtcac

SEQ ID NO: 839 - DNA, 10 bp, Artificial Sequence
  Description of Artificial Sequence: Synthetic oligonucleotide
cgccattgcc

SEQ ID NO: 840 - DNA, 10 bp, Artificial Sequence
  Description of Artificial Sequence: Synthetic oligonucleotide
gtgtgatgtt

SEQ ID NO: 841 - DNA, 14 bp, Artificial Sequence
  Description of Artificial Sequence: Synthetic oligonucleotide
tgatctggaggagg

SEQ ID NO: 842 - DNA, 14 bp, Artificial Sequence
  Description of Artificial Sequence: Synthetic oligonucleotide
gtctgggcagcttt

SEQ ID NO: 843 - DNA, 13 bp, Artificial Sequence
  Description of Artificial Sequence: Synthetic oligonucleotide
caccgtcagtgct

SEQ ID NO: 844 - DNA, 10 bp, Artificial Sequence
  Description of Artificial Sequence: Synthetic oligonucleotide
ggcacctgcc

SEQ ID NO: 845 - DNA, 18 bp, Artificial Sequence
  Description of Artificial Sequence: Synthetic primer
tgtaaaacgacggccagt

SEQ ID NO: 846 - DNA, 19 bp, Artificial Sequence
  Description of Artificial Sequence: Synthetic primer
aggaaacagctatgaccat

SEQ ID NO: 847 - DNA, 18 bp, Artificial Sequence
  Description of Artificial Sequence: Synthetic primer
gagacgcggcgcggcttc

SEQ ID NO: 848 - DNA, 20 bp, Artificial Sequence
  Description of Artificial Sequence: Synthetic primer
cgccccaactcgctcccaac

SEQ ID NO: 849 - DNA, 17 bp, Artificial Sequence
  Description of Artificial Sequence: Synthetic primer
tcccgcgcgcccagctc

SEQ ID NO: 850 - DNA, 17 bp, Artificial Sequence
  Description of Artificial Sequence: Synthetic primer
tcgccaagtcgcttccg

SEQ ID NO: 851 - DNA, 18 bp, Artificial Sequence
  Description of Artificial Sequence: Synthetic primer
aaggaactggaggtcttg

SEQ ID NO: 852 - DNA, 19 bp, Artificial Sequence
  Description of Artificial Sequence: Synthetic primer
cagagtcacaccctttttc

SEQ ID NO: 853 - DNA, 17 bp, Artificial Sequence
  Description of Artificial Sequence: Synthetic primer
ggcatgggcagggcagt

SEQ ID NO: 854 - DNA, 19 bp, Artificial Sequence
  Description of Artificial Sequence: Synthetic primer
tgaaaaacaacttgggctc

SEQ ID NO: 855 - DNA, 18 bp, Artificial Sequence
  Description of Artificial Sequence: Synthetic primer
ccaagttctgagaagtcc

SEQ ID NO: 856 - DNA, 20 bp, Artificial Sequence
  Description of Artificial Sequence: Synthetic primer
aatacctgaaaccatacctg

SEQ ID NO: 857 - DNA, 17 bp, Artificial Sequence
  Description of Artificial Sequence: Synthetic primer
tgcattcctcagggccc

SEQ ID NO: 858 - DNA, 18 bp, Artificial Sequence
  Description of Artificial Sequence: Synthetic primer
ttggttatttccgatggg

SEQ ID NO: 859 - DNA, 20 bp, Artificial Sequence
  Description of Artificial Sequence: Synthetic primer
ggcgtagtggtgggcatcag

SEQ ID NO: 860 - DNA, 20 bp, Artificial Sequence
  Description of Artificial Sequence: Synthetic primer
cccagccagccacacacctc

SEQ ID NO: 861 - DNA, 17 bp, Artificial Sequence
  Description of Artificial Sequence: Synthetic primer
actgtcgggggaccctc

SEQ ID NO: 862 - DNA, 17 bp, Artificial Sequence
  Description of Artificial Sequence: Synthetic primer
attgcagcaggtacccc

SEQ ID NO: 863 - DNA, 20 bp, Artificial Sequence
  Description of Artificial Sequence: Synthetic primer
gggaaattgcaggccgtctg

SEQ ID NO: 864 - DNA, 20 bp, Artificial Sequence
  Description of Artificial Sequence: Synthetic primer
ctgaggaccaaggcggagag

SEQ ID NO: 865 - DNA, 17 bp, Artificial Sequence
  Description of Artificial Sequence: Synthetic primer
aggctgagggccccatg

SEQ ID NO: 866 - DNA, 17 bp, Artificial Sequence
  Description of Artificial Sequence: Synthetic primer
caggattgacctcctgg

SEQ ID NO: 867 - DNA, 18 bp, Artificial Sequence
  Description of Artificial Sequence: Synthetic primer
cacctaacatcaccagcc

SEQ ID NO: 868 - DNA, 18 bp, Artificial Sequence
  Description of Artificial Sequence: Synthetic primer
gatgcaagacagtgtccc

SEQ ID NO: 869 - DNA, 17 bp, Artificial Sequence
  Description of Artificial Sequence: Synthetic primer
cctggctgagtatttcc

SEQ ID NO: 870 - DNA, 17 bp, Artificial Sequence
  Description of Artificial Sequence: Synthetic primer
tcaatctccctctcgcc

SEQ ID NO: 871 - DNA, 20 bp, Artificial Sequence
  Description of Artificial Sequence: Synthetic primer
acaccgacatttacgagcac

SEQ ID NO: 872 - DNA, 20 bp, Artificial Sequence
  Description of Artificial Sequence: Synthetic primer
aaatagcagagcacaggcac

SEQ ID NO: 873 - DNA, 18 bp, Artificial Sequence
  Description of Artificial Sequence: Synthetic primer
cgacatttactgacacca

SEQ ID NO: 874 - DNA, 17 bp, Artificial Sequence
  Description of Artificial Sequence: Synthetic primer
ccatcggtgcctcgcca

SEQ ID NO: 875 - DNA, 25 bp, Artificial Sequence
  Description of Artificial Sequence: Synthetic primer
tctcaaacaaacaaacaaacaaaaa

SEQ ID NO: 876 - DNA, 21 bp, Artificial Sequence
  Description of Artificial Sequence: Synthetic primer
tccttggccagatactgtcac

SEQ ID NO: 877 - DNA, 19 bp, Artificial Sequence
  Description of Artificial Sequence: Synthetic primer
acaaacaaacaaagcgtca

SEQ ID NO: 878 - DNA, 17 bp, Artificial Sequence
  Description of Artificial Sequence: Synthetic primer
ctttcctgtcctgccct

SEQ ID NO: 879 - DNA, 18 bp, Artificial Sequence
  Description of Artificial Sequence: Synthetic primer
tgtgtggcgggaataaag

SEQ ID NO: 880 - DNA, 18 bp, Artificial Sequence
  Description of Artificial Sequence: Synthetic primer
ttgaggcaggaacagagg

SEQ ID NO: 881 - DNA, 17 bp, Artificial Sequence
  Description of Artificial Sequence: Synthetic primer
ctgtgcacattggagct

SEQ ID NO: 882 - DNA, 19 bp, Artificial Sequence
  Description of Artificial Sequence: Synthetic primer
caaggttttcccataaagg

SEQ ID NO: 883 - DNA, 19 bp, Artificial Sequence
  Description of Artificial Sequence: Synthetic primer
atgtctacaaaacacgctg

SEQ ID NO: 884 - DNA, 18 bp, Artificial Sequence
  Description of Artificial Sequence: Synthetic primer
ctaatcactgagggccac

SEQ ID NO: 885 - DNA, 17 bp, Artificial Sequence
  Description of Artificial Sequence: Synthetic primer
gttctggcctggcgtgg

SEQ ID NO: 886 - DNA, 17 bp, Artificial Sequence
  Description of Artificial Sequence: Synthetic primer
acggacagcctgccacc

SEQ ID NO: 887 - DNA, 18 bp, Artificial Sequence
  Description of Artificial Sequence: Synthetic primer
tcaccttacgagtgagcc

SEQ ID NO: 888 - DNA, 18 bp, Artificial Sequence
  Description of Artificial Sequence: Synthetic primer
agcctctcccgacataac

SEQ ID NO: 889 - DNA, 17 bp, Artificial Sequence
  Description of Artificial Sequence: Synthetic primer
actgtgggaattcaggg

SEQ ID NO: 890 - DNA, 17 bp, Artificial Sequence
  Description of Artificial Sequence: Synthetic primer
tgcagcaaaggcaccca

SEQ ID NO: 891 - DNA, 18 bp, Artificial Sequence
  Description of Artificial Sequence: Synthetic primer
gaaaaccagcaaaagccc

SEQ ID NO: 892 - DNA, 19 bp, Artificial Sequence
  Description of Artificial Sequence: Synthetic primer
tgtccatcacgaagtccag

SEQ ID NO: 893 - DNA, 17 bp, Artificial Sequence
  Description of Artificial Sequence: Synthetic primer
atgagggcggccatgtg

SEQ ID NO: 894 - DNA, 17 bp, Artificial Sequence
  Description of Artificial Sequence: Synthetic primer
gcggttccggccgctag

SEQ ID NO: 895 - DNA, 22 bp, Artificial Sequence
  Description of Artificial Sequence: Synthetic primer
acagcgattatatctactggac

SEQ ID NO: 896 - DNA, 18 bp, Artificial Sequence
  Description of Artificial Sequence: Synthetic primer
atggaaagcactcagcac

SEQ ID NO: 897 - DNA, 18 bp, Artificial Sequence
  Description of Artificial Sequence: Synthetic primer
agactggaatctgcacag

SEQ ID NO: 898 - DNA, 17 bp, Artificial Sequence
  Description of Artificial Sequence: Synthetic primer
tgtgctggcagtatgag

SEQ ID NO: 899 - DNA, 21 bp, Artificial Sequence
  Description of Artificial Sequence: Synthetic primer
agaatgaaattccccatagcg

SEQ ID NO: 900 - DNA, 21 bp, Artificial Sequence
  Description of Artificial Sequence: Synthetic primer
agacaaaagtcctgtggggtc

SEQ ID NO: 901 - DNA, 17 bp, Artificial Sequence
  Description of Artificial Sequence: Synthetic primer
tcccgtggacctccagc

SEQ ID NO: 902 - DNA, 17 bp, Artificial Sequence
  Description of Artificial Sequence: Synthetic primer
acaacggggaaacccag

SEQ ID NO: 903 - DNA, 21 bp, Artificial Sequence
  Description of Artificial Sequence: Synthetic primer
gagagacccccacaccaatac

SEQ ID NO: 904 - DNA, 20 bp, Artificial Sequence
  Description of Artificial Sequence: Synthetic primer
caggtggaaagtctccccag

SEQ ID NO: 905 - DNA, 18 bp, Artificial Sequence
  Description of Artificial Sequence: Synthetic primer
tgggatttgactttcagg

SEQ ID NO: 906 - DNA, 17 bp, Artificial Sequence
  Description of Artificial Sequence: Synthetic primer
cctgtgagaggctggca

SEQ ID NO: 907 - DNA, 21 bp, Artificial Sequence
  Description of Artificial Sequence: Synthetic primer
cagttggatttagggcctacc

SEQ ID NO: 908 - DNA, 21 bp, Artificial Sequence
  Description of Artificial Sequence: Synthetic primer
cagctgtcagtgtgaggacaa

SEQ ID NO: 909 - DNA, 17 bp, Artificial Sequence
  Description of Artificial Sequence: Synthetic primer
ctcacccattgtggtcg

SEQ ID NO: 910 - DNA, 18 bp, Artificial Sequence
  Description of Artificial Sequence: Synthetic primer
aacacgctacacacaaag

SEQ ID NO: 911 - DNA, 19 bp, Artificial Sequence
  Description of Artificial Sequence: Synthetic primer
aactgatggccttcatccc

SEQ ID NO: 912 - DNA, 21 bp, Artificial Sequence
  Description of Artificial Sequence: Synthetic primer
tcttaaaacgctgttcgtggt

SEQ ID NO: 913 - DNA, 17 bp, Artificial Sequence
  Description of Artificial Sequence: Synthetic primer
gagcccagcccaggtgg

SEQ ID NO: 914 - DNA, 20 bp, Artificial Sequence
  Description of Artificial Sequence: Synthetic primer
gatttgttctgcggcaaaag

SEQ ID NO: 915 - DNA, 21 bp, Artificial Sequence
  Description of Artificial Sequence: Synthetic primer
agactgatggtatgggcacag

SEQ ID NO: 916 - DNA, 21 bp, Artificial Sequence
  Description of Artificial Sequence: Synthetic primer
atttgtgagatgcaggaaacg

SEQ ID NO: 917 - DNA, 17 bp, Artificial Sequence
  Description of Artificial Sequence: Synthetic primer
tagagactggtgcagac

SEQ ID NO: 918 - DNA, 20 bp, Artificial Sequence
  Description of Artificial Sequence: Synthetic primer
cagtacttagaggaaaattc

SEQ ID NO: 919 - DNA, 21 bp, Artificial Sequence
  Description of Artificial Sequence: Synthetic primer
attctcccagcctctcttctg

SEQ ID NO: 920 - DNA, 21 bp, Artificial Sequence
  Description of Artificial Sequence: Synthetic primer
gcaggaaggtgagatagaccc

SEQ ID NO: 921 - DNA, 17 bp, Artificial Sequence
  Description of Artificial Sequence: Synthetic primer
ggttggggctggaggtg

SEQ ID NO: 922 - DNA, 18 bp, Artificial Sequence
  Description of Artificial Sequence: Synthetic primer
tcacagtctgccttcaag

SEQ ID NO: 923 - DNA, 21 bp, Artificial Sequence
  Description of Artificial Sequence: Synthetic primer
ggggtctgttactccttgcat

SEQ ID NO: 924 - DNA, 21 bp, Artificial Sequence
  Description of Artificial Sequence: Synthetic primer
cagctcacagtctgtcctcct

SEQ ID NO: 925 - DNA, 17 bp, Artificial Sequence
  Description of Artificial Sequence: Synthetic primer
ggcgtagacctccccac

SEQ ID NO: 926 - DNA, 17 bp, Artificial Sequence
  Description of Artificial Sequence: Synthetic primer
ccgctgccctgggaaag

SEQ ID NO: 927 - DNA, 19 bp, Artificial Sequence
  Description of Artificial Sequence: Synthetic primer
acgttaccctgaggttggc

SEQ ID NO: 928 - DNA, 21 bp, Artificial Sequence
  Description of Artificial Sequence: Synthetic primer
aggcctctgtgttgaaggatt

SEQ ID NO: 929 - DNA, 17 bp, Artificial Sequence
  Description of Artificial Sequence: Synthetic primer
aggctccccaggcctag

SEQ ID NO: 930 - DNA, 17 bp, Artificial Sequence
  Description of Artificial Sequence: Synthetic primer
ctgatgccaagcacagg

SEQ ID NO: 931 - DNA, 21 bp, Artificial Sequence
  Description of Artificial Sequence: Synthetic primer
ttggaggaggtaccatgtgtc

SEQ ID NO: 932 - DNA, 21 bp, Artificial Sequence
  Description of Artificial Sequence: Synthetic primer
ggtggatttgggtgagatttt

SEQ ID NO: 933 - DNA, 18 bp, Artificial Sequence
  Description of Artificial Sequence: Synthetic primer
tcccgtttcacagatgag

SEQ ID NO: 934 - DNA, 19 bp, Artificial Sequence
  Description of Artificial Sequence: Synthetic primer
cagattatccacaatcaac

SEQ ID NO: 935 - DNA, 20 bp, Artificial Sequence
  Description of Artificial Sequence: Synthetic primer
ttctgctgatttctgaaccc

SEQ ID NO: 936 - DNA, 20 bp, Artificial Sequence
  Description of Artificial Sequence: Synthetic primer
ttgcctttcactgagatgac

SEQ ID NO: 937 - DNA, 17 bp, Artificial Sequence
  Description of Artificial Sequence: Synthetic primer
aacatgcagtgcccgct

SEQ ID NO: 938 - DNA, 17 bp, Artificial Sequence
  Description of Artificial Sequence: Synthetic primer
cttcggggcaggtggct

SEQ ID NO: 939 - DNA, 19 bp, Artificial Sequence
  Description of Artificial Sequence: Synthetic primer
ggcctgcatcttctggagc

SEQ ID NO: 940 - DNA, 18 bp, Artificial Sequence
  Description of Artificial Sequence: Synthetic primer
cattccctccacggggac

SEQ ID NO: 941 - DNA, 17 bp, Artificial Sequence
  Description of Artificial Sequence: Synthetic primer
tggccagtggacaggcc

SEQ ID NO: 942 - DNA, 19 bp, Artificial Sequence
  Description of Artificial Sequence: Synthetic primer
acacaactcaaatgcacac

SEQ ID NO: 943 - protein, 25 aa, Homo sapiens
LILPLHGLRNVKAIDYDPLDKFIYW

SEQ ID NO: 944 - protein, 25 aa, Homo sapiens
KFIYWVDGRQNIKRAKDDGTQPFVL

SEQ ID NO: 945 - protein, 25 aa, Homo sapiens
QPFVLTSLSQGQNPDRQPHDLSIDI

SEQ ID NO: 946 - protein, 25 aa, Homo sapiens
LSIDIYSRTLFWTCEATNTINVHRL

SEQ ID NO: 947 - protein, 25 aa, Homo sapiens
NVHRLSGEAMGVVLRGDRDKPRAIV

SEQ ID NO: 948 - protein, 14 aa, Homo sapiens
CGEPPTCSPDQFAC

SEQ ID NO: 949 - protein, 18 aa, Homo sapiens
WRCDGFPECDDQSDEEGC

SEQ ID NO: 950 - protein, 17 aa, Homo sapiens
RCDGEADCQDRSDEADC

SEQ ID NO: 951 - protein, 14 aa, Homo sapiens
CEITKPPSDDSPAH

SEQ ID NO: 952 - protein, 13 aa, Homo sapiens
MYWTDWVETPRIE

SEQ ID NO: 953 - protein, 13 aa, Homo sapiens
MYWTDWGETPRIE

SEQ ID NO: 954 - protein, 13 aa, Homo sapiens
KRTGGKRKEILSA

SEQ ID NO: 955 - protein, 17 aa, Homo sapiens
ERVEKTTGDKRTRIQGR

SEQ ID NO: 956 - protein, 16 aa, Homo sapiens
KQQCDSFPDCIDGSDE

SEQ ID NO: 957 - protein, 15 aa, Homo sapiens
GNKYQTIDNYQPYPC

SEQ ID NO: 958 - protein, 22 aa, Homo sapiens
LDGYSRRTTLSSKMYHTKGQEG

SEQ ID NO: 959 - protein, 21 aa, Homo sapiens
RIQKDHHQASNSSRLHTCQRH

SEQ ID NO: 960 - protein, 15 aa, Homo sapiens
RGEIEETITESFGND

SEQ ID NO: 961 - protein, 17 aa, Homo sapiens
EIFQRCGEGLSCRIQKD

SEQ ID NO: 962 - DNA, 34 bp, Artificial Sequence
  Description of Artificial Sequence: Synthetic oligonucleotide
cagtgaattcaccatgcaaaacaccactttgttc

SEQ ID NO: 963 - DNA, 32 bp, Artificial Sequence
  Description of Artificial Sequence: Synthetic oligonucleotide
cagttgcggccgctcatctccggtggcctctg

SEQ ID NO: 964 - DNA, 39 bp, Artificial Sequence
  Description of Artificial Sequence: Synthetic oligonucleotide
caatagtcgacgaattcaccatggctctgggcgcagcgg

SEQ ID NO: 965 - DNA, 42 bp, Artificial Sequence
  Description of Artificial Sequence: Synthetic oligonucleotide
gtattgcggccgctctagattagtgtctctgacaagtgtgaa

SEQ ID NO: 966 - DNA, 32 bp, Artificial Sequence
  Description of Artificial Sequence: Synthetic oligonucleotide
ctaacggatccaccatggccgcgttgatgcgg

SEQ ID NO: 967 - DNA, 33 bp, Artificial Sequence
  Description of Artificial Sequence: Synthetic oligonucleotide
gattcgaattctcaaattttctgacacacatgg

SEQ ID NO: 968 - DNA, 40 bp, Artificial Sequence
  Description of Artificial Sequence: Synthetic oligonucleotide
gaaggtgctcttctggcaggacggtgaccagccgagggcc

SEQ ID NO: 969 - DNA, 40 bp, Artificial Sequence
  Description of Artificial Sequence: Synthetic oligonucleotide
ggccctcggctggtcaccgtcctgccagaagagcaccttc

SEQ ID NO: 970 - DNA, 40 bp, Artificial Sequence
  Description of Artificial Sequence: Synthetic oligonucleotide
gatcattgtggactcggacggttactggcccaatggactg

SEQ ID NO: 971 - DNA, 40 bp, Artificial Sequence
  Description of Artificial Sequence: Synthetic oligonucleotide
cagtccattgggccagtaaccgtccgagtccacaatgatc

SEQ ID NO: 972 - DNA, 47 bp, Artificial Sequence
  Description of Artificial Sequence: Synthetic oligonucleotide
catttactggcccaatggagtgaccatcgacctggaggagcagaagc

SEQ ID NO: 973 - DNA, 47 bp, Artificial Sequence
  Description of Artificial Sequence: Synthetic oligonucleotide
gcttctgctcctccaggtcgatggtcactccattgggccagtaaatg

SEQ ID NO: 974 - DNA, 47 bp, Artificial Sequence
  Description of Artificial Sequence: Synthetic oligonucleotide
catttactggcccaatggactggtcatcgacctggaggagcagaagc

SEQ ID NO: 975 - DNA, 47 bp, Artificial Sequence
  Description of Artificial Sequence: Synthetic oligonucleotide
gcttctgctcctccaggtcgatgaccagtccattgggccagtaaatg

SEQ ID NO: 976 - DNA, 47 bp, Artificial Sequence
  Description of Artificial Sequence: Synthetic oligonucleotide
catttactggcccaatggactgaccgtcgacctggaggagcagaagc

SEQ ID NO: 977 - DNA, 47 bp, Artificial Sequence
  Description of Artificial Sequence: Synthetic oligonucleotide
gcttctgctcctccaggtcgacggtcagtccattgggccagtaaatg

SEQ ID NO: 978 - DNA, 42 bp, Artificial Sequence
  Description of Artificial Sequence: Synthetic oligonucleotide
ggcaagaagctgtactggtcggactcagagaccaaccgcatc

SEQ ID NO: 979 - DNA, 42 bp, Artificial Sequence
  Description of Artificial Sequence: Synthetic oligonucleotide
gatgcggttggtctctgagtccgaccagtacagcttcttgcc

SEQ ID NO: 980 - DNA, 42 bp, Artificial Sequence
  Description of Artificial Sequence: Synthetic oligonucleotide
ggcaagaagctgtactggggggactcagagaccaaccgcatc

SEQ ID NO: 981 - DNA, 42 bp, Artificial Sequence
  Description of Artificial Sequence: Synthetic oligonucleotide
gatgcggttggtctctgagtccccccagtacagcttcttgcc

SEQ ID NO: 982 - DNA, 43 bp, Artificial Sequence
  Description of Artificial Sequence: Synthetic oligonucleotide
gaagctgtactggacggacgtagagaccaaccgcatcgaggtg

SEQ ID NO: 983 - DNA, 43 bp, Artificial Sequence
  Description of Artificial Sequence: Synthetic oligonucleotide
cacctcgatgcggttggtctctacgtccgtccagtacagcttc

SEQ ID NO: 984 - DNA, 41 bp, Artificial Sequence
  Description of Artificial Sequence: Synthetic oligonucleotide
cctgacgcaccccgtcgccctgacgctctccggggacactc

SEQ ID NO: 985 - DNA, 41 bp, Artificial Sequence
  Description of Artificial Sequence: Synthetic oligonucleotide
gagtgtccccggagagcgtcagggcgacggggtgcgtcagg

SEQ ID NO: 986 - DNA, 41 bp, Artificial Sequence
  Description of Artificial Sequence: Synthetic oligonucleotide
cctgacgcaccccttcgtcctgacgctctccggggacactc

SEQ ID NO: 987 - DNA, 41 bp, Artificial Sequence
  Description of Artificial Sequence: Synthetic oligonucleotide
gagtgtccccggagagcgtcaggacgaaggggtgcgtcagg

SEQ ID NO: 988 - DNA, 40 bp, Artificial Sequence
  Description of Artificial Sequence: Synthetic oligonucleotide
ctactgggctgacgccgtgctcagcttcatccaccgtgcc

SEQ ID NO: 989 - DNA, 40 bp, Artificial Sequence
  Description of Artificial Sequence: Synthetic oligonucleotide
ggcacggtggatgaagctgagcacggcgtcagcccagtag

SEQ ID NO: 990 - DNA, 40 bp, Artificial Sequence
  Description of Artificial Sequence: Synthetic oligonucleotide
cttggaccccgctcacggggccatgtactggacagactgg

SEQ ID NO: 991 - DNA, 40 bp, Artificial Sequence
  Description of Artificial Sequence: Synthetic oligonucleotide
ccagtctgtccagtacatggccccgtgagcggggtccaag

SEQ ID NO: 992 - DNA, 41 bp, Artificial Sequence
  Description of Artificial Sequence: Synthetic oligonucleotide
ggaccccgctcacgggtacgcgtactggacagactggggtg

SEQ ID NO: 993 - DNA, 41 bp, Artificial Sequence
  Description of Artificial Sequence: Synthetic oligonucleotide
caccccagtctgtccagtacgcgtacccgtgagcggggtcc

SEQ ID NO: 994 - DNA, 41 bp, Artificial Sequence
  Description of Artificial Sequence: Synthetic oligonucleotide
cccgctcacgggtacatggcctggacagactggggtgagac

SEQ ID NO: 995 - DNA, 41 bp, Artificial Sequence
  Description of Artificial Sequence: Synthetic oligonucleotide
gtctcaccccagtctgtccaggccatgtacccgtgagcggg

SEQ ID NO: 996 - DNA, 41 bp, Artificial Sequence
  Description of Artificial Sequence: Synthetic oligonucleotide
cgctcacgggtacatgtacgcgacagactggggtgagacgc

SEQ ID NO: 997 - DNA, 41 bp, Artificial Sequence
  Description of Artificial Sequence: Synthetic oligonucleotide
gcgtctcaccccagtctgtcgcgtacatgtacccgtgagcg

SEQ ID NO: 998 - DNA, 41 bp, Artificial Sequence
  Description of Artificial Sequence: Synthetic oligonucleotide
gctcacgggtacatgtactgggcagactggggtgagacgcc

SEQ ID NO: 999 - DNA, 41 bp, Artificial Sequence
  Description of Artificial Sequence: Synthetic oligonucleotide
ggcgtctcaccccagtctgcccagtacatgtacccgtgagc

SEQ ID NO: 1000 - DNA, 41 bp, Artificial Sequence
  Description of Artificial Sequence: Synthetic oligonucleotide
cacgggtacatgtactggacagcctggggtgagacgccccg

SEQ ID NO: 1001 - DNA, 41 bp, Artificial Sequence
  Description of Artificial Sequence: Synthetic oligonucleotide
cggggcgtctcaccccaggctgtccagtacatgtacccgtg

SEQ ID NO: 1002 - DNA, 42 bp, Artificial Sequence
  Description of Artificial Sequence: Synthetic oligonucleotide
caacttggatgggcaggagcagcgtgtgctggtcaatgcctc

SEQ ID NO: 1003 - DNA, 42 bp, Artificial Sequence
  Description of Artificial Sequence: Synthetic oligonucleotide
gaggcattgaccagcacacgctgctcctgcccatccaagttg

SEQ ID NO: 1004 - DNA, 42 bp, Artificial Sequence
  Description of Artificial Sequence: Synthetic oligonucleotide
gcagcgccgcagcatcgagtgggtgcacaaggtcaaggccag

SEQ ID NO: 1005 - DNA, 42 bp, Artificial Sequence
  Description of Artificial Sequence: Synthetic oligonucleotide
ctggccttgaccttgtgcacccactcgatgctgcggcgctgc

SEQ ID NO: 1006 - DNA, 41 bp, Artificial Sequence
  Description of Artificial Sequence: Synthetic oligonucleotide
cgagaccaataacaacgacatggccatcccgctcacgggcg

SEQ ID NO: 1007 - DNA, 41 bp, Artificial Sequence
  Description of Artificial Sequence: Synthetic oligonucleotide
cgcccgtgagcgggatggccatgtcgttgttattggtctcg

SEQ ID NO: 1008 - DNA, 81 bp, Artificial Sequence
  Description of Artificial Sequence: Synthetic construct
aagcttgccaccatggagacagacacactcctgctatgggtactgctgctctgggttccaggttccactggtgacggatcc

SEQ ID NO: 1009 - DNA, 485 bp, Artificial Sequence
  Description of Artificial Sequence: Synthetic construct
aagcttgccaccatggagacagacacactcctgctatgggtactgctgctctgggttccaggttccactggtgacggatccatgagcgataaaattattcacctgactgacgacagttttgacacggatgtactcaaagcggacggggcgatcctcgtcgatttctgggcagagtggtgcggtccgaattccgtggttctgtgttcgcgttgtgggcgtttgtggcggtggtcgtgtgggactagtggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagcggccgc

SEQ ID NO: 1010 - DNA, 485 bp, Artificial Sequence
  Description of Artificial Sequence: Synthetic construct
aagcttgccaccatggagacagacacactcctgctatgggtactgctgctctgggttccaggttccactggtgacggatccatgagcgataaaattattcacctgactgacgacagttttgacacggatgtactcaaagcggacggggcgatcctcgtcgatttctgggcagagtggtgcggtccgaattccgggtggcggtggtgtggtcggtgtggggctttgtggtggcggcgtgttactagtggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagcggccgc

SEQ ID NO: 1011 - DNA, 485 bp, Artificial Sequence
  Description of Artificial Sequence: Synthetic construct
aagcttgccaccatggagacagacacactcctgctatgggtactgctgctctgggttccaggttccactggtgacggatccatgagcgataaaattattcacctgactgacgacagttttgacacggatgtactcaaagcggacggggcgatcctcgtcgatttctgggcagagtggtgcggtccgaattccgaggtgcggcaggttacgtgtattaggtgtcgtcggggttttctgttgactagtggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagcggccgc

SEQ ID NO: 1012 - DNA, 485 bp, Artificial Sequence
  Description of Artificial Sequence: Synthetic construct
aagcttgccaccatggagacagacacactcctgctatgggtactgctgctctgggttccaggttccactggtgacggatccatgagcgataaaattattcacctgactgacgacagttttgacacggatgtactcaaagcggacggggcgatcctcgtcgatttctgggcagagtggtgcggtccgaattccggtggtggggggatgatttgggaggcttggagttgttatgcgtgtgggactagtggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagcggccgc

SEQ ID NO: 1013 - DNA, 485 bp, Artificial Sequence
  Description of Artificial Sequence: Synthetic construct
aagcttgccaccatggagacagacacactcctgctatgggtactgctgctctgggttccaggttccactggtgacggatccatgagcgataaaattattcacctgactgacgacagttttgacacggatgtactcaaagcggacggggcgatcctcgtcgatttctgggcagagtggtgcggtccgaattccttgtggattgggccgggtgatcagggtctgtttcggcgttttgtttttactagtggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagcggccgc

SEQ ID NO: 1014 - DNA, 476 bp, Artificial Sequence
  Description of Artificial Sequence: Synthetic construct
aagcttgccaccatggagacagacacactcctgctatgggtactgctgctctgggttccaggttccactggtgacggatccgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaagcggccgc

SEQ ID NO: 1015 - DNA, 539 bp, Artificial Sequence
  Description of Artificial Sequence: Synthetic construct
aagcttgccaccatggagacagacacactcctgctatgggtactgctgctctgggttccaggttccactggtgacggatcctgcgctagtcccacccgcggaggggacgcgggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgctaagcggccgc

SEQ ID NO: 1016 - DNA, 416 bp, Artificial Sequence
  Description of Artificial Sequence: Synthetic construct
aagcttgccaccatgggcgataaaattattcacctgactgacgacagttttgacacggatgtactcaaagcggacggggcgatcctcgtcgatttctgggcagagtggtgcggtccgaattcctatgcgtggttgttttcttgtagtaggtgtaggtggtggttgccttggactagtggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagcggccgc

SEQ ID NO: 1017 - DNA, 416 bp, Artificial Sequence
  Description of Artificial Sequence: Synthetic construct
aagcttgccaccatgggcgataaaattattcacctgactgacgacagttttgacacggatgtactcaaagcggacggggcgatcctcgtcgatttctgggcagagtggtgcggtccgaattccatttgtgaggttgtgaggttgtggagtcggtatccttggtcttgggtgactagtggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagcggccgc

SEQ ID NO: 1018 - DNA, 422 bp, Artificial Sequence
  Description of Artificial Sequence: Synthetic construct
aagcttgccaccatgggcgataaaattattcacctgactgacgacagttttgacacggatgtactcaaagcggacggggcgatcctcgtcgatttctgggcagagtggtgcggtccgaattccggttgtactagtgcggtgtgtggtgcttgggctgaggcgggtaggttttattgtactagtggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagcggccgc

SEQ ID NO: 1019 - DNA, 416 bp, Artificial Sequence
  Description of Artificial Sequence: Synthetic construct
aagcttgccaccatgggcgataaaattattcacctgactgacgacagttttgacacggatgtactcaaagcggacggggcgatcctcgtcgatttctgggcagagtggtgcggtccgaattccttgtggattgggccgggtgatcagggtctgtttcggcgttttgtttttactagtggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagcggccgc

SEQ ID NO: 1020 - protein, 23 aa, Artificial Sequence
  Description of Artificial Sequence: Synthetic construct
METDTLLLWVLLLWVPGSTGDGS

SEQ ID NO: 1021 - protein, 154 aa, Artificial Sequence
  Description of Artificial Sequence: Synthetic construct
METDTLLLWVLLLWVPGSTGDGSMSDKIIHLTDDSFDTDVLKADGAILVDFWAEWCGPNSVVLCSRCGRLWRWSCGTSGPCKMIAPILDEIADEYQGKLTVAKLNIDQNPGTAPKYGIRGIPTLLLFKNGEVAATKVGALSKGQLKEFLDANLA

SEQ ID NO: 1022 - protein, 154 aa, Artificial Sequence
  Description of Artificial Sequence: Synthetic construct
METDTLLLWVLLLWVPGSTGDGSMSDKIIHLTDDSFDTDVLKADGAILVDFWAEWCGPNSGWRWCGRCGALWWRRVTSGPCKMIAPILDEIADEYQGKLTVAKLNIDQNPGTAPKYGIRGIPTLLLFKNGEVAATKVGALSKGQLKEFLDANLA

SEQ ID NO: 1023 - protein, 154 aa, Artificial Sequence
  Description of Artificial Sequence: Synthetic construct
METDTLLLWVLLLWVPGSTGDGSMSDKIIHLTDDSFDTDVLKADGAILVDFWAEWCGPNSEVRQVTCIRCRRGFLLTSGPCKMIAPILDEIADEYQGKLTVAKLNIDQNPGTAPKYGIRGIPTLLLFKNGEVAATKVGALSKGQLKEFLDANLA

SEQ ID NO: 1024 - protein, 154 aa, Artificial Sequence
  Description of Artificial Sequence: Synthetic construct
METDTLLLWVLLLWVPGSTGDGSMSDKIIHLTDDSFDTDVLKADGAILVDFWAEWCGPNSGGGGMIWEAWSCYACGTSGPCKMIAPILDEIADEYQGKLTVAKLNIDQNPGTAPKYGIRGIPTLLLFKNGEVAATKVGALSKGQLKEFLDANLA

SEQ ID NO: 1025 - protein, 154 aa, Artificial Sequence
  Description of Artificial Sequence: Synthetic construct
METDTLLLWVLLLWVPGSTGDGSMSDKIIHLTDDSFDTDVLKADGAILVDFWAEWCGPNSLWIGPGDQGLFRRFVFTSGPCKMIAPILDEIADEYQGKLTVAKLNIDQNPGTAPKYGIRGIPTLLLFKNGEVAATKVGALSKGQLKEFLDANLA

SEQ ID NO: 1026 - protein, 151 aa, Artificial Sequence
  Description of Artificial Sequence: Synthetic construct
METDTLLLWVLLLWVPGSTGDGSVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 1027 - protein, 172 aa, Artificial Sequence
  Description of Artificial Sequence: Synthetic construct
METDTLLLWVLLLWVPGSTGDGSCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSC

SEQ ID NO: 1028 - protein, 131 aa, Artificial Sequence
  Description of Artificial Sequence: Synthetic construct
MGDKIIHLTDDSFDTDVLKADGAILVDFWAEWCGPNSYAWLFSCSRCRWWLPWTSGPCKMIAPILDEIADEYQGKLTVAKLNIDQNPGTAPKYGIRGIPTLLLFKNGEVAATKVGALSKGQLKEFLDANLA

SEQ ID NO: 1029 - protein, 131 aa, Artificial Sequence
  Description of Artificial Sequence: Synthetic construct
MGDKIIHLTDDSFDTDVLKADGAILVDFWAEWCGPNSICEVVRLWSRYPWSWVTSGPCKMIAPILDEIADEYQGKLTVAKLNIDQNPGTAPKYGIRGIPTLLLFKNGEVAATKVGALSKGQLKEFLDANLA

SEQ ID NO: 1030 - protein, 133 aa, Artificial Sequence
  Description of Artificial Sequence: Synthetic construct
MGDKIIHLTDDSFDTDVLKADGAILVDFWAEWCGPNSGCTSAVCGAWAEAGRFYCTSGPCKMIAPILDEIADEYQGKLTVAKLNIDQNPGTAPKYGIRGIPTLLLFKNGEVAATKVGALSKGQLKEFLDANLA

SEQ ID NO: 1031 - protein, 131 aa, Artificial Sequence
  Description of Artificial Sequence: Synthetic construct
MGDKIIHLTDDSFDTDVLKADGAILVDFWAEWCGPNSLWIGPGDQGLFRRFVFTSGPCKMIAPILDEIADEYQGKLTVAKLNIDQNPGTAPKYGIRGIPTLLLFKNGEVAATKVGALSKGQLKEFLDANLA

SEQ ID NO: 1032 - protein, 921 aa, Mus musculus
PASPLLLFANRRDVRLVDAGGVKLESTIVASGLEDAAAVDFQFSKGAVYWTDVSEEPEAFLVFTSRATIHRISLETNNNDVAIPLTGVKEASALDFDVSNNHIYWTDVSLKGAEEVLLLARRTDLRRISLDTPDFTDIVLQVGDIRHAIAIDYDPLEGYVYWTDDEVRPSTFLLFSQKFAISRMIPDDQLSPDLVLPLHGLRNVKAINYDPLDKFIYWVDGRQNAIKQTYLNQTGAAAQNIVISGLVSPDGLACDWVGKKLYWTDSETNRIEVANLNGTSTISRAFMNGSSVEHVIEFGLDYPEGMAVDWMGKNLYWADTGTNRIEVARLDGQFAIRRAYLDGSGAQTLVNTEINDPDGIAVDWVARNLYWTDTGTDRIEVTRLNGTSIKRAKDDGTQPSMLTSPSQSLSPDRQPHDLSIDIYSRTLFWTCEATNTINVHRLDGDARKVLFWQDLDQPRAIALDPAHGYMYWTDWGEAPRIERAGMDGSTRKIIVDSDIYWPNGLRQVLVWRDLDNPRSLALDPTKGYIYWTEWGGKPRIVRAFMDGTNCMTLVDKVGRANDLRKILVSEDLDEPRAIVLHPVMGLMYWTDWGENPKIECANLDGRDRHVLVNTSLGWPNGLMGVVLRGDRDKPRAIAVNAERGYMYFTNMQDHAAKIERASLDGTEREVLFTTGLIRPVALTIDLEEQKLYWADAKLSFIHRANLDGSFRQKVVEGSLTHPFALTLSGDTLYWTDWQTRSITIDYADQRLYWTDLDTNMIESSNMLGQERMVIADDLPYPFGLTQYSDYIYWTDWNLHSIALDLQEGKLYWGDAKTDKIEVINIDGTKRKTLLEDKLPHIFGFTLLGDFIYWTDWQRRSIVVDNALGKLFWVDADLKRIESCDLSGANRLTLEDANIVQPVGLTVLGRHLYWIDRQQQMI

SEQ ID NO: 1033 - protein, 231 aa, Mus musculus
PASPLLLFANRRDVRLVDAGGVKLESTIVASGLEDAAAVDFQFSKGAVYWTDVSEEAIKQTYLNQTGAAAQNIVISGLVSPDGLACDWVGKKLYWTDSETNRIEVANLNGTSRKVLFWQDLDQPRAIALDPAHGYMYWTDWGEAPRIERAGMDGSTRKIIVDSDIYWPNGLTIDLEEQKLYWADAKLSFIHHANLDGSFRQKVVEGSLTHPFALTLSGDTLYWTDWQTRSI

SEQ ID NO: 1034 - protein, 918 aa, Homo sapiens
PASPLLLFANRRDVRLVDAGGVKLESTIVVSGLEDAAAVDFQFSKGAVYWTDVSEEPEAFLVFTSRAAIHRISLETNNNDVAIPLTGVKEASALDFDVSNNHIYWTDVSLKEVLLLARRTDLRRISLDTPDFTDIVLQVDDIRHAIAIDYDPLEGYVYWTDDEVRPTTFLLFSQKSAISRMIPDDQHSPDLILPLHGLRNVKAIDYDPLDKFIYWVDGRQNAIKQTYLNQTGAAVQNVVISGLVSPDGLACDWVGKKLYWTDSETNRIEVANLNGTSTISRAFMNGSSVEHVVEFGLDYPEGMAVDWMGKNLYWADTGTNRIEVARLDGQFAIRRAYLDGSGAQTLVNTEINDPDGIAVDWVARNLYWTDTGTDRIEVTRLNGTSIKRAKDDGTQPFVLTSLSQGQNPDRQPHDLSIDIYSRTLFWTCEATNTINVHRLSGEARKVLFWQDLDQPRAIALDPAHGYMYWTDWGETPRIERAGMDGSTRKIIVDSDIYWPNGLRQVLVWRDLDNPRSLALDPTKGYIYWTEWGGKPRIVRAFMDGTNCMTLVDKVGRANDLRKILVSEDLDEPRAIALHPVMGLMYWTDWGENPKIECANLDGQERRVLVNASLGWPNGLMGVVLRGDRDKPRAIVVNAERGYLYFTNMQDRAAKIERAALDGTEREVLFTTGLIRPVALTIDLEEQKLYWADAKLSFIHRANLDGSFRQKVVEGSLTHPFALTLSGDTLYWTDWQTRSITIDYADQRLYWTDLDTNMIESSNMLGQERVVIADDLPHPFGLTQYSDYIYWTDWNLHSIALDLQEGKLYWGDAKTDKIEVINVDGTKRRTLLEDKLPHIFGFTLLGDFIYWTDWQRRSIVVDNTLGKLFWVDADLKRIESCDLSGANRLTLEDANIVQPLGLTILGKHIYWIDRQQQMI

SEQ ID NO: 1035 - protein, 921 aa, Homo sapiens [sequence omitted]

SEQ ID NO: 1036 - protein, 865 aa, Mus musculus
PAPLLLYANRRDLRLVDATNGKENATIVVGGLEDAAAVDFVFGHGLIYWSDVSEEPEAFLLFSRRADIRRISLETNNNNVAIPLTGVKEASALDFDVTDNRIYWTDISLKGATELLLLARRTDLRRISLDTPDFTDIVLQLEDIRHAIAIDYDPVEGYIYWTDDEVRAIKRTEFNKSESVQNVVVSGLLSPDGLACDWLGEKLYWTDSETNRIEVSNLDGSLTISRAFMNGSALEHVVEFGLDYPEGMAVDWLGKNLYWADTGTNRIEVSKLDGQHAIRRSFIDGSGSQFVVTAQIAHPDGIAVDWVARNLYWTDTGTDRIEVTRLNGTMSIRKAHEDGGQGFNVVANSVANQNLEIQPYDLSIDIYSRYIYWTCEATNVIDVTRLDGRSRKVLFWQELDQPRAIALDPSSGFMYWTDWGEVPKIERAGMDGSSRFVIINTEIYWPNGLRQVLVWKDLDSPRALALDPAEGFMYWTEWGGKPKIDRAAMDGSERTTLVPNVGRANGLRKILISEDLEEPRAIVLDPMVGYMYWTDWGEIPKIERAALDGSDRVVLVNTSLGWPNGLVGVVLKGEQDRPRAIVVNPEKGYMYFTNLQERSPKIERAALDGTEREVLFFSGLSKPIALTLDYQERKLYWADAKLNFIHKSNLDGTNRQAVVKGSLPHPFALTLFEDTLYWTDWNTHSITIDYAKRRLYWTDLDTNLIESSDMLGLNREVIADDLPHPFGLTQYQDYIYWTDWSRRSIALDYDEGTIYWGDAKTDKIEVMNTDGTGRRVLVEDKIPHIFGFTLLGDYVYWTDWQRRSIALDSKLGKLFWADSDLRRIESSDLSGANRIVLEDSNILQPVGLTVFENWLYWIDKQQQMI

SEQ ID NO: 1037 - protein, 231 aa, Gallus sp.
PDEEPFLIFANRYYLRKLNLDGSNYTLLKQGLNNAVALDFDYREQMIYWTDVTTQGSMIRRMHINGSNVQVLHRTGLSNPDGLAVDWVGGNLYWCDKGRDTIEVSKLNGAYTRVLVNSGLREPRALVVDVQNGYLYWTDWGDHSLIGKIGMDGTNRSVIVDTKITWPNGLTLDYINSRIYWADAREDYIEFASLDGSNRHTVLSQDIPHIFALTLFEDYIYWTDEWETKSI

SEQ ID NO: 1038 - protein, 234 aa, Homo sapiens
PPPGTHLLFAQTGKIERLPLEGNTMRKTEAKAFLHVPAKVIIGLAFDCVDKMVYWTDITEPSIGRASLHGGEPTTIINQDLGSPEGIAVDHLGRNIFWTDSNLDRIEVAKLDGTQRRVLFETDLVNPRGIVTDSVRGNLYWTDWNRDNPKIETSYMDGTNRRILVQDDLGLPNGLHFDAFSSQLCWVDAGTNRAECLNPSQPSRRKALEGLQYPFAVTSYGKNLYFTDWKMNSV

SEQ ID NO: 1039 - protein, 231 aa, Homo sapiens
PCCCEEHHHHCCCCCEEECCCCCCCEEEEECCCCCEEEEEECCCCCEEEEECCCHHHHHHEEECCCCCCCEEEEEECCCCCCCEEEEECCCCEEEECCCCCEEEEEECCCCCCEEEEECCCCCCCCEEECCCCCEEEEECCCCCCHHHHHCCCCCCEEEEEECCCCCCCCCCCCCCCCCEEEECCCCCEEEEECCCCCCCCEEECCCCCCCCEEECCCCCEEECCCCCHHH

SEQ ID NO: 1040 - DNA, 11 bp, Homo sapiens
gatgatgatga

SEQ ID NO: 1041 - DNA, 11 bp, Homo sapiens
gatgatgatga

SEQ ID NO: 1042 - DNA, 11 bp, Homo sapiens
gatgatgatga

SEQ ID NO: 1043 - DNA, 11 bp, Homo sapiens
gatgatgatga

SEQ ID NO: 1044 - DNA, 11 bp, Homo sapiens
gatgatgatga

SEQ ID NO: 1045 - DNA, 11 bp, Homo sapiens
gatgatgatga

SEQ ID NO: 1046 - DNA, 11 bp, Homo sapiens
gatgatgatga

SEQ ID NO: 1047 - DNA, 11 bp, Homo sapiens
gatgatgatga

SEQ ID NO: 1048 - DNA, 11 bp, Homo sapiens
gatgatgatga

SEQ ID NO: 1049 - DNA, 11 bp, Homo sapiens
gatgatgatga

SEQ ID NO: 1050 - DNA, 11 bp, Homo sapiens
gatgatgatga

SEQ ID NO: 1051 - DNA, 11 bp, Homo sapiens
gatgatgatga

SEQ ID NO: 1052 - DNA, 11 bp, Homo sapiens
gatgatgatga

SEQ ID NO: 1053 - DNA, 11 bp, Homo sapiens
gatgatgatga

SEQ ID NO: 1054 - DNA, 11 bp, Homo sapiens
gatgatgatga

SEQ ID NO: 1055 - DNA, 11 bp, Homo sapiens
gatgatgatga

SEQ ID NO: 1056 - DNA, 11 bp, Homo sapiens
gatgatgatga

SEQ ID NO: 1057 - DNA, 11 bp, Homo sapiens
gatgatgatga

SEQ ID NO: 1058 - DNA, 11 bp, Homo sapiens
gatgatgatga

SEQ ID NO: 1059 - DNA, 11 bp, Homo sapiens
gatgatgatga

SEQ ID NO: 1060 - DNA, 11 bp, Homo sapiens
gatgatgatga

SEQ ID NO: 1061 - DNA, 11 bp, Homo sapiens
gatgatgatga

SEQ ID NO: 1062 - DNA, 11 bp, Homo sapiens
gatgatgatga

SEQ ID NO: 1063 - DNA, 11 bp, Homo sapiens
gatgatgatga

SEQ ID NO: 1064 - DNA, 11 bp, Homo sapiens
gatgatgatga

SEQ ID NO: 1065 - DNA, 11 bp, Homo sapiens
gatgatgatga

SEQ ID NO: 1066 - DNA, 11 bp, Homo sapiens
gatgatgatga

SEQ ID NO: 1067 - DNA, 11 bp, Homo sapiens
gatgatgatga

SEQ ID NO: 1068 - DNA, 11 bp, Homo sapiens
gatgatgatga

SEQ ID NO: 1069 - DNA, 11 bp, Homo sapiens
gatgatgatga

SEQ ID NO: 1070 - DNA, 11 bp, Homo sapiens
gatgatgatga

SEQ ID NO: 1071 - DNA, 11 bp, Homo sapiens
gatgatgatga

SEQ ID NO: 1072 - DNA, 11 bp, Homo sapiens
gatgatgatga

SEQ ID NO: 1073 - DNA, 11 bp, Homo sapiens
gatgatgatga

SEQ ID NO: 1074 - DNA, 11 bp, Homo sapiens
gatgatgatga

SEQ ID NO: 1075 - DNA, 11 bp, Homo sapiens
gatgatgatga

SEQ ID NO: 1076 - DNA, 11 bp, Homo sapiens
gatgatgatga

SEQ ID NO: 1077 - DNA, 11 bp, Homo sapiens
gatgatgatga

SEQ ID NO: 1078 - DNA, 11 bp, Homo sapiens
gatgatgatga

SEQ ID NO: 1079 - DNA, 11 bp, Homo sapiens
gatgatgatga

SEQ ID NO: 1080 - DNA, 11 bp, Homo sapiens
gatgatgatga

SEQ ID NO: 1081 - DNA, 11 bp, Homo sapiens
gatgatgatga

SEQ ID NO: 1082 - DNA, 11 bp, Homo sapiens
gatgatgatga

SEQ ID NO: 1083 - DNA, 11 bp, Homo sapiens
gatgatgatga

SEQ ID NO: 1084 - DNA, 11 bp, Homo sapiens
gatgatgatga

SEQ ID NO: 1085 - DNA, 11 bp, Homo sapiens
gatgatgatga

SEQ ID NO: 1086 - DNA, 11 bp, Homo sapiens
gatgatgatga

SEQ ID NO: 1087 - protein, 4 aa, Artificial Sequence
  Description of Artificial Sequence: Synthetic peptide
YWTD

SEQ ID NO: 1088 - protein, 20 aa, Artificial Sequence
  Description of Artificial Sequence: Synthetic peptide
YWTDYWTDYWTDYWTDYWTD

SEQ ID NO: 1089 - protein, 16 aa, Artificial Sequence
  Description of Artificial Sequence: Synthetic peptide
VVLCSRCGRLWRWSCG

SEQ ID NO: 1090 - protein, 16 aa, Artificial Sequence
  Description of Artificial Sequence: Synthetic peptide
EVRQVTCIRCRRGFLL

SEQ ID NO: 1091 - protein, 15 aa, Artificial Sequence
  Description of Artificial Sequence: Synthetic peptide
GGGGMWEAWSCYACG

SEQ ID NO: 1092 - protein, 16 aa, Artificial Sequence
  Description of Artificial Sequence: Synthetic peptide
GWRWCGRCGALWWRRV

SEQ ID NO: 1093 - protein, 267 aa, Mus sp.
ASPLLLFANRRDVRLVDAGGVKLESTIVASGLEDAAAVDFQFSKGAVYWTDVSEEAIKQTYLNQTGAAAQNIVISGLVSPDGLACDWVGKKLYWTDSETNRIEVANLNGTSRKVLFWQDLDQPRAIALDPAHGYMYWTDWGEAPRIERAGMDGSTRKIIVDSDIYWPNGLTIDLEEQKLYWADAKLSFIHRANLDGSFRQKVVEGSLTHPFALTLSGDTLYWTDWQTRSIHACNKWTGEQRKEILSALYSPMDIQVLSQERQPPFHT

SEQ ID NO: 1094 - protein, 267 aa, Mus sp.
ASPLLLFANRRDVRLVDAGGVKLESTIVASGLEDAAAVDFQFSKGAVYWTDVSEEAIKQTYLNQTGAAAQNIVISGLVSPDGLACDWVGKKLYWTDSETNRIEVANLNGTSRKVLFWQDLDQPRAIALDPAHGYMYWTDWGEAPRIERAGMDGSTRKIIVDSDIYWPNGLTIDLEEQKLYWADAKLSFIHHANLDGSFRQKVVEGSLTHPFALTLSGDTLYWTDWQTRSIHACNKWTGEQRKEILSALYSPMDIQVLSQERQPPFHT

SEQ ID NO: 1095 - protein, 267 aa, Homo sapiens
ASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHT

SEQ ID NO: 1096 - protein, 263 aa, Homo sapiens
APLLLYANRRDLRLVDATNGKENATIVVGGLEDAAAVDFVFSHGLIYWSDVSEEAIKRTEFNKTESVQNVVVSGLLSPDGLACDWLGEKLYWTDSETNRIEVSNLDGSLRKVLFWQELDQPRAIALDPSSGFMYWTDWGEVPKIERAGMDGSSRFIIINSEIYWPNGLTLDYEEQKLYWADAKLNFIHKSNLDGTNRQAVVKGSLPHPFALTLFEDILYWTDWSTHSILACNKYTGEGLREIHSDIFSPMDIHAFSQQRQPNA

SEQ ID NO: 1097 - protein, 263 aa, Mus sp.
APLLLYANRRDLRLVDATNGKENATIVVGGLEDAAAVDFVFGHGLIYWSDVSEEAIKRTEFNKSESVQNVVVSGLLSPDGLACDWLGEKLYWTDSETNRIEVSNLDGSLRKVLFWQELDQPRAIALDPSSGFMYWTDWGEVPKIERAGMDGSSRFVIINTEIYWPNGLTLDYQERKLYWADAKLNFIHKSNLDGTNRQAVVKGSLPHPFALTLFEDTLYWTDWNTHSILACNKYTGEGLREIHSNIFSPMDIHAFSQQRQPNA

SEQ ID NO: 1098 - protein, 260 aa, Gallus sp.
DEEPFLIFANRYYLRKLNLDGSNYTLLKQGLNNAVALDFDYREQMIYWTDVTTQGSMIRRMHINGSNVQVLHRTGLSNPDGLAVDWVGGNLYWCDKGRDTIEVSKLNGAYRTVLVNSGLREPRALVVDVQNGYLYWTDWGDHSLIGKIGMDGTNRSVIVDTKITWPNGLTLDYINSRIYWADAREDYIEFASLDGSNRHTVLSQDIPHIFALTLFEDYIYWTDWETKSINRAHKTTGANKTLLISTLHRPMDIHIYHPYR

SEQ ID NO: 1099 - protein, 261 aa, Mus sp.
PEAFLVFTSRATIHRISLETNNNDVAIPLTGVKEASALDFDVSNNHIYWTDVSLKTISRAFMNGSSVEHVIEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERMVIADDLPYPFGLTQYSDYIYWTDWNLHSIERADKTSGRNRTLIQGHLDFVMDILVFHSSRQDGL

SEQ ID NO: 1100 - protein, 261 aa, Homo sapiens
PEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGL

SEQ ID NO: 1101 - protein, 260 aa, Homo sapiens
PEAFLLFSRRADIRRISLETNNNNVAIPLTGVKEASALDFDVTDNRIYWTDISLKTISRAFMNGSALEHVVEFGLDYPEGMAVDWLGKNLYWADTGTNRIEVSKLDGQHRQVLVWKDLDSPRALALDPAEGFMYWTEWGGKPKIDRAAMDGSERTTLVPNVGRANGLTIDYAKRRLYWTDLDTNLIESSNMLGLNREVIADDLPHPFGLTQYQDYIYWTDWSRRSIERANKTSGQNRTIIQGHLDYVMDILVFHSSRQSG

SEQ ID NO: 1102 - protein, 260 aa, Mus sp.
PEAFLLFSRRADIRRISLETNNNNVAIPLTGVKEASALDFDVTDNRIYWTDISLKTISRAFMNGSALEHVVEFGLDYPEGMAVDWLGKNLYWADTGTNRIEVSKLDGQHRQVLVWKDLDSPRALALDPAEGFMYWTEWGGKPKIDRAAMDGSERTTLVPNVGRANGLTIDYAKRRLYWTDLDTNLIESSDMLGLNREVIADDLPHPFGLTQYQDYIYWTDWSRRSIERANKTSGQNRTIIQGHLDYVMDILVFHSSRQAG

SEQ ID NO: 1103 - protein, 264 aa, Mus sp.
GAEEVLLLARRTDLRRISLDTPDFTDIVLQVGDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIVLHPVMGLMYWTDWGENPKIECANLDGRDRHVLVNTSLGWPNGLALDLQEGKLYWGDAKTDKIEVINIDGTKRKTLLEDKLPHIFGFTLLGDFIYWTDWQRRSIERVHKVKASRDVIIDQLPDLMGLKAVNVAKVVGT

SEQ ID NO: 1104 - protein, 261 aa, Homo sapiens
EVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGT

SEQ ID NO: 1105 - protein, 263 aa, Homo sapiens
GATELLLLARRTDLRRISLDTPDFTDIVLQLEDIRHAIAIDYDPVEGYIYWTDDEVRAIRRSFIDGSGSQFVVTAQIAHPDGIAVDWVARNLYWTDTGTDRIEVTRLNGTMRKILISEDLEEPRAIVLDPMVGYMYWTDWGEIPKIERAALDGSDRVVLVNTSLGWPNGLALDYDEGKIYWGDAKTDKIEVMNTDGTGRRVLVEDKIPHIFGFTLLGDYVYWTDWQRRSIERVHKRSAEREVIIDQLPDLMGLKATNVHRVIG

SEQ ID NO: 1106 - protein, 263 aa, Mus sp.
GATELLLLARRTDLRRISLDTPDFTDIVLQLEDIRHAIAIDYDPVEGYIYWTDDEVRAIRRSFIDGSGSQFVVTAQIAHPDGIAVDWVARNLYWTDTGTDRIEVTRLNGTMRKILISEDLEEPRAIVLDPMVGYMYWTDWGEIPKIERAALDGSDRVVLVNTSLGWPNGLALDYDEGTIYWGDAKTDKIEVMNTDGTGRRVLVEDKIPHIFGFTLLGDYVYWTDWQRRSIERVHKRSAEREVIIDQLPDLMGLKATSVHRVIG

SEQ ID NO: 1107 - protein, 266 aa, Homo sapiens
PPGTHLLFAQTGKIERLPLEGNTMRKTEAKAFLHVPAKVIIGLAFDCVDKMVYWTDITEPSIGRASLHGGEPTTIIRQDLGSPEGIAVDHLGRNIFWTDSNLDRIEVAKLDGTQRRVLFETDLVNPRGIVTDSVRGNLYWTDWNRDNPKIETSYMDGTNRRILVQDDLGLPNGLHFDAFSSQLCWVDAGTNRAECLNPSQPSRRKALEGLQYPFAVTSYGKNLYFTDWKMNSVVALDLAISKETDAFQPHKQTRLYGITTALSQCP

SEQ ID NO: 1108 - protein, 271 aa, Mus sp.
PSTFLLFSQKFAISRMIPDDQLSPDLVLPLHGLRNVKAINYDPLDKFIYWVDGRQNIKRAKDDGTQPSMLTSPSQSLSPDRQPHDLSIDIYSRTLFWTCEATNTINVHRLDGDAMGVVLRGDRDKPRAIAVNAERGYMYFTNMQDHAAKIERASLDGTEREVLFTTGLIRPVALVVDNALGKLFWVDADLKRIESCDLSGANRLTLEDANIVQPVGLTVLGRHLYWIDRQQQMIERVEKTTGDKRTRVQGRVTHLTGIHAVEEVSLEEFSA

SEQ ID NO: 1109 - protein, 271 aa, Homo sapiens
PTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSA

SEQ ID NO: 1110 - protein, 272 aa, Homo sapiens
PTTFLLFSQKSAINRMVIDEQQSPDIILPIHSLRNVRAIDYDPLDKQLYWIDSRQNMIRKAQEDGSQGFTVVVSSVPSQNLEIQPYDLSIDIYSRYIYWTCEATNVINVTRLDGRSVGVVLKGEQDRPRAIVVNPEKGYMYFTNLQERSPKIERAALDGTEREVLFFSGLSKPIALALDSRLGKLFWADSDLRRIESSDLSGANRIVLEDSNILQPVGLTVFENWLYWIDKQQQMIEKIDMTGREGRTKVQARIAQLSDIHAVKELNLQEYR

SEQ ID NO: 1111 - protein, 272 aa, Mus sp.
PSTFLLFSQKSAINRMVIDEQQSPDIILPIHSLRNVRAIDYDPLDKQLYWIDSRQNSIRKAHEDGGQGFNVVANSVANQNLEIQPYDLSIDIYSRYIYWTCEATNVIDVTRLDGRSVGVVLKGEQDRPRAIVVNPEKGYMYFTNLQERSPKIERAALDGTEREVLFFSGLSKPIALALDSKLGKLFWADSDLRRIESSDLSGANRIVLEDSNILQPVGLTVFENWLYWIDKQQQMIEKIDMTGREGRTKVQARIAQLSDIHAVKELNLQEYR

What is claimed is:

1. An isolated nucleic acid that encodes a low density lipoprotein receptor-related protein 5 (LRP5) or a low density lipoprotein receptor-related protein 6 (LRP6), wherein said encoded LRP5 or LRP6 differs from a mammalian LRP5 or LRP6 sequence in propeller 1 of said LRP5 or LRP6, and wherein said different LRP5 or LRP6 has one or more of the following activities: (a) said different LRP or LRP6 increases bone mass, or (b) said different LRP5 or LRP6 decreases a lipid in a subject.

2. An isolated nucleic acid encoding a low density lipoprotein receptor-related protein 5 (LRP5) which differs from mammalian LRP5 by one or more of the following activities: a mutation of Tables 2 or 3, G171V, A214V, A65V, M282V, G171K, G171F, G171I, G171Q, L200V, T201V, I202V, or S127V, and wherein said different LRP5 has one or both of the following: (1) said different LRP5 increases bone mass, or (b) said different LRP5 decreases a lipid in a subject.

3. An isolated nucleic acid encoding a mammalian low density lipoprotein receptor-related protein 6 (LRP6) which differs from SEQ ID NO: 764, by a mutation in a position equivalent to a human low density lipoprotein receptor-related protein 5 (LRP5) mutation of Tables 2 or 3, a LRP5 mutation of G171V, A214V, A65V, M282V, G171K, G171F, G171I, G171Q, L200V, T201V, I202V, or S127V of SEQ ID NO: 3, and wherein said different LRP6 has one or both of the following activities: (a) said different LRP6 increases bone mass, or (b) said different LRP6 decreases a lipid in a subject.

4. An isolated nucleic acid encoding a low density lipoprotein receptor-related protein 5 (LRP5), wherein said LRP5 differs from SEQ ID NO: 3 by at least one amino acid mutation in propeller 1, and wherein said different LRP5 has one or both of the following activities: (a) said different LRP5 increases bone mass, or (b) said different LRP5 decreases a lipid in a subject.

5. The isolated nucleic acid of claim 2, wherein said nucleic acid encodes for a LRP5 having at least one mutation selected from the group consisting of: G171V, A214V, A65V, M282V, G171K, G171F, G171I, G171Q, L200V, T201V, I202V, and S127V.

6. An isolated nucleic acid encoding a low density lipoprotein receptor-related protein 6 (LRP6), wherein said LRP6 differs from SEQ ID NO: 764 by at least one amino acid mutation in propeller 1, wherein said different LRP6 has one or both of the following activities: (a) said different LRP6 increases bone mass, or (b) said different LRP6 decreases a lipid in a subject.

7. The isolated nucleic acid of claim 3, wherein said nucleic acid encodes for a LRP6 having at least one mutation in an equivalent position of LRP6 selected from the group of LRP5 mutations consisting of: G171V, A214V, A65V, M282V, G171K, G171F, G171I, G171Q, L200V, T201V, I202V, and S127V.

8. The isolated nucleic acid of claim 1, wherein the mutation is G171V, A214V, A65V, M282V, G171K, G171F, G171I, or G171Q in human LRP5 or in an equivalent position in a mammalian LRP6.

9. An isolated LRP5 or LRP6 encoded by the isolated nucleic acid of claim 1, wherein said isolated LRP5 or LRP6 increases Wnt signaling or decreases a Dkk activity in a subject.

10. A vector comprising the isolated nucleic acid of claim 1.

11. An isolated cell comprising the vector of claim 10.

12. The cell of claim 11, wherein said cell is a cancer cell, a liver cell or a bone cell.

13. An isolated low density lipoprotein receptor-related protein 5 (LRP5) differing from human LRP5 by one or more of the following: an amino acid change of Table 2, G171V, A214V, A65V, M282V, G171K, G171F, G171I, G171Q, L200V, T201V, I202V. or S127V, wherein said isolated LRP5 increases bone mass in a subject.

14. The isolated LRP5 of claim 13, wherein said LRP5 comprises at least one amino acid change of G171V, A214V, A65V, M282V, G171K, G171F, G171I, G171Q, L200V, T201V, I202V, or S127V.

15. An isolated low density lipoprotein receptor-related protein 6 (LRP6) differing from human LRP6 by at least one amino acid change in an equivalent position of LRP6 selected from the group consisting of human low density lipoprotein receptor-related protein 5 (LRP5) mutations of Table 2, G171V, A214V, A65V, M282V, G171K, G171F, G171I, G171Q, L200V, T201V, I202V, and S127V, and wherein at least propeller 1 of LRP6 is present in said isolated LRP6, and wherein said isolated LRP6 has one or both of the following activities: (a) said isolated LRP6 increases bone mass, or (b) said isolated LRP6 decreases a lipid in a subject.

16. The isolated LRP6 of claim 15, wherein said LRP6 comprises at least one amino acid change of G171V, A214V, A65V, M282V, G171K, G171F, G171I, G171Q, L200V, or S127V.

17. An isolated low density lipoprotein receptor-related protein 5 (LRP5) or low density lipoprotein receptor-related protein 6 (LRP6), which differs from SEQ ID NO: 3 or SEQ ID NO: 764 respectively by at least one amino acid mutation in propeller 1 with the proviso that if the mutation is G171V that a second mutation maintains the high bone mass (HBM)-like phenotype is also present, and wherein said isolated LRP5 increases a Wnt activity and increases bone mass in a subiect.

18. The isolated LRP5 of claim 13, wherein the amino acid change is G171V, A214V, A65V, M282V, G171K, G171F, G171I, or G171Q.

19. A method of identifying agents which increases bone mass comprising: (a) transfecting a cell with a vector of claim 10; (b) exposing the transfected cell of step (a) to a compound; and (c) determining whether the compound increases bone mass.

20. A method of identifying agents which increase bone mass and decrease a lipid comprising: (a) transfecting a cell with the isolated nucleic acid of claim 2; (b) exposing the transfected cell of step (a) to a compound; and (c) determining whether the compound increases bone mass and decreases a lipid.

21. The method of claim 20, wherein the compound is a hormone, a growth factor, a peptide, RNA, shRNA, siRNA, DNA, a mineral, a vitamin, a natural product, or a synthetic organic compound.

22. A method for identifying compounds which modulate the interaction of Dkk with the Wnt signaling pathway comprising: (a) transfecting cells with constructs containing the isolated nucleic acid of claim 2; (b) assessing changes in expression of a reporter element linked to a Wnt-responsive promoter; and (c) identifying as a Dkk/Wnt interaction modulating compound any compound which alters reporter gene expression compared with cells transfected with a Dkk construct alone.

23. The method according to claim 22, wherein the cells are cancer cells, liver cells or bone cells.

24. The method according to claim 23, wherein the cells are U2-OS, HOB-03-CE6, or HEK293 cells.

25. The method according to claim 22, wherein the reporter element used is TCF-luciferase, tk-Renilla, or a combination thereof.

26. The method for identifying agents of claim 23, further comprising a step of determining whether the agent further modulates bone mass lipid levels.

\* \* \* \* \*